United States Patent 7,368,527 (HADDE71 POLYPEPTIDES) - sequence listing, part 8

SEQ ID NO: 12478 - DNA, 45172 bp, Homo sapiens
ttctattttcttagttcttttttttttattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccgtagtatgatgtccccttcctgtgtccatgcgttctccttgttcaattcccacctatgagtgagaacatgtggtgtttggttttttgtccttgtgatagtttactgagaatgatgatttccaacttcatccatgtccctacaaaggaaacgaactcatcattttttatggctgcatagtattccatggtgtatatgtgccacattttcttaatccagtctatcattgttggacatttggattggttccaagtctttgctattgtgaatagtgctgcaataaacatacgtgtacgtgtgtctttatagcagcatgatttatagtcctttgggtatatacccagtaatgggatggctgggtcaaatggtatttctagttctagatccctgaggaattgccacactgacttccacaatgtttgaactagtttacagtcccaccaacagtgtaaaagtgttcctatttctccacatcctctccagcttctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgtttaagacatgaagtccttgcccatgcctaggtcctgaatggtaatgcctaggttttcttctagggtttttatggttttaggtctaacatttaagtctttaatccatcttgaattaatttttgtataaggtgtaaggaagggatccagtttcagctttctacatatggctagcccgttttcccagcaccatttattaaatagggaatcctttccccattgcttgtttttctcaggtttgtcaaagatcagatagttgtagatatgcggtgtcatttctgagggctctgttctgttccattgatctatatctctcttttggtaccagtaccatgctgttttggttactgtagccttgtagtatagtttgaagtcaggtagtgtgatgcctccagctttgttcttttggcttaggattgacttggtgatgcgggctctttgttggttccctatgaactttaaagtagttttttccaattcttgaagaaagtcattggtagcttgatggggatggcattgaatctgtaaattaccttgggcagtatggccaacaaagccaggcagagacacaaccaaaaaagagaattttagaccaatatccttgatgaacactgatgcaaaaatcctcaataaaatactggcaaaccgtatccagcagcacatcaaaaagcttatccaccatgatcaagtgggcttcatccctgggatgcaaggctggttcaatatacgcaaatcaataaatgtaatccagcatgtaaacagaaccaaagacaaaaaccacatgattatctcaatagatgcagaaaaggcctttgacaaaattcaacaacacttcatgctaaacactctcaataaattaggtattgatgggacgtatctcaacataataagagctatctatgacaaacccacagacaatatcatactgaatgggcaaaaactggaagcattccctttgaaaactggcacaagacagggatgccctctctcaccactcctattcaatatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccaataacagagaaacagagagccaaatcatgagtgaactaccattcacaattgcttcaaagggaataaaatacttaggaatccaacttacaagggacgtgaaggacctcttcaaggagaagtgcaaaccactcctcaatgaaataaaagaggatacaaacaaatggaagaacattctattttcttagttctttatatgcctagcaattttctgctatatcctggatacaatgaatgttaaattatgaagatttgggattctcttatttttctctgatgaacgttgtttcttttgttttagcaggtgatttttttcggtgggaggtggggctgggcttgaacttcaaaagttactttttgggcagcatctccattatctgttcagattgactttaaatatgtctgtgtgcaggaattacccatgagttgtcagtttgcaacctctatattagaatgttatggtctttaattgagatgcctttagtctgttctataaatgcctgattcagagatcactaaaaaatgtgggtagacagaatttggatatgtattctctggttctttctcaggtaggattctccccatggcttcagcattcagtttattggattcaattttttggtttcacaaatcagaagacaaatcccagccaattcatataccaaacctgagccacacagaatttacccatgtaacaaacctgcacatggactgcctgaacttaaaataaaagtagggaaaaaaagtagggaacaaactaccaaaataaaataaaacattcagaacacacgcaagaaggaaagtgatcacatctgtcatgcatcaacttatgctttccctttgaaactttgcatacattgattacagagcatacctatctggttggctcaggagaggaaggttgggctgaattagtcttttccagacagaggcatgaaagtctctttctctcttgtgaagcagacatcaacccaactgcatatgagaagagggcatagagggagccaagttggggagatctgactgtcttctcctgttctggcctatgatctttacctcacacgtttacccactggtaatctctattatggaataggaaccatagcatggcacagatagcaatccttgtgcaccaggaactaattcaagtggatcagaaaagcccagggatatggggattgtgctaaaaggagcagcggtggcattcctgaacactgagaagagtgtttccaacatctgaagagatgctacattttccagcctactaggctgaaagataaaaacaacttttgttgactcctctgaaaacttgagaatttaactgaaatatgtaaatgaaattttgaatacatatgaaatgtgaagccttctgatatttggtccataaattatgtttcaccagagtttagatcataaaatttttccattgcagacaaactactggtctttctgttcctatacattataaacccaagatgtgtcacattatgtaatgaaaaccaaatagaaatttgttctttaaggaatttcataataaaaaacaaaacaaaacaaacaaacaaatgagccaagcatggtgtgcacacctgtattcctggctacttgagaggctgaggtgggataattgcttgagcccaagagctatgatcatgccactggactccagccttggtgacagagcaagaccccatctctgaaagaaaaaaaaagtataatgaacacatgagtccctctattcagcataaaaaaattaccataacttcccaattatgttccgtttttcttttttttttttactggaatatttctagagaaatccaagctatcgtatcactttattctaaatactttagactcctatatgtgtctataaccaataaacattttttcttgtttatcttactatttatccattattacaaataaataaattaataattattccctgtcatcatttaatatctgttctatattctaagtttcctacactgtatcaaaaatagcttttaattgttgtgtttgtttcaggatccaaacaaagtccacttctgactttcagagattctaccacaaaaatatcttatttctacaattgccaccttccctcacctagttttcatatcatttcattaaggtattggagaaattagatcaattgacttgtagaatgtcctacactgttgacttggtatcatctaacttgtttctgtatccgccatatttcctattaaactgaaagtcagatccagaggcttgcttaaattcagcttgaattccttgggcatgatgcttcagagggagtgctgtgtatttcctctgcgttgtgctgtgatatctcgtcgtcccctgttaatgatggtcattaagattgatgagtgagttcctgtgttatcagtccaattcatccattgcgtaatccccatagcctttctcctaatggttttagcatccactgatgattgttaccaagatccattatctcactagatgttgcaaaatgaaacataataaaacaaaacaaaatgatttcttaattctgtcattcttcttcttttaaaagcttgtatttgtctacaaagaaggaatttctccagtcaactatttgtgttccctgaaataaggtttattcagaaaaaaaaagtgtttttttgaatatcaattttcagaataaaagattggtagtcgagtcagaaaaatctaagtgtggagtgcacttagctgctgactaacaattgcagagatgggaatgtacttatctaccttccaccaagtaaacgtgtacttcccatccaacagacacttctgaccactctccactacattcaagtattcactttttgtttcatgcctgagttttatatttgttttcttcagtgggatggaggagagagttgtcaggtagggtaataatataccatacctagaactgaaattctctgtagtttaaattttttaaatgaatacttccaaacataaacaaaaatagaaaattgtacaatggacccacatataccaatcaccagactcagtcattatcaagatttgcctcacttgccacatctatctctttttgttctttctcatttttcataagtatttaagacaagtctcagacatcacataatttcacctctacatacaatcatggatactctgttacataacccttatttatggttagtgagaatgtgaatgagtacagtcattatggaaaacagtatggaaggctctctaaaactaaaaatagaattaccatacaatacagtacttcacccacatttgttgcagcagtattcccatggccaagatatggaattaatttaagtgtccatcaatatatgaatggataaagaaaattttgtatacatactctgtaatctattcagccattagaaaacaatgaaatcctgtcatttgcagcaatattgatggaactagaggtcattatgttaagtaaaataagccaggaataaaaagacaaatatcacacatttgcactcatatgtgggagctagaaaagttgatctcatggagttagaatgtagagtgatagttgtcacaggctgggaagggtagggtagatgaaaaaaggttggttaatgggtacaaacatacagttagataaaaggaatacattccaacttttaacagcacagcaggattactatcattgataataatttattgtatatttcaaaacagctagaagagaagatttaagtgttcccaacacaaaaaaatgataaatgtttgaggtgatggatagcataaataccctgatttgatcattacatattgtatgcatgtatcaaaatatcacatatacctcacaaatatgtattattattttgtatcaataaataatctaatatcttgtctacaagtaaatattcctggttatttaaaaatgtgtgctctaattaggattgaaacaaaatttataaattccacttaattgatacctctttggtctttgtgaatctagaacagtatcttctctcacttttattttccctgccattgactagttagagaaaccacaacagttgttcttatggaatatcccactttctggatttgtctatgtccttcttagtttctctgtcttccttatttttataaatgaaagttaactctggggacttaattacactcagcttcaacttcctgggaacagtacttcacagatggtgctgtgtgcctgacgtcacaatgtctggataacctaacaatttttacatttcactctaaataagaagtcacaaactgacaacacatagccaaatctttcacataaacacatttgaatttaagtgtcagttgttaattcttgtttttcttgcacaattgtttttcctatagtaattgaaaggaaaataaaaaataataactttctgtagctgtatctcagtcaaaagcaggaaaatggaagatcactttcatagtagtccagtttcatgctgctgataaagacatacccgagactgggaagaaaaagaggtttaattggacttacagttccacatggctggggaagcctcagaatcatggtgagaggcaaaaggcacttcttacatggtagcagcaagagaaaatgagaggaatgcaaatgcagaaacccctgaaaaaaccatcagatttcaagagacttattcactaccatgagaatagtatgagagaaactgcccccatgattcaaattatctcctgccaggcccctcccataacacatgacaattatgggagtacaattcaagatgagatttgagtggggacacagagccaaaccatatcattccaaccctggcccctccaaatctcatgtccttacgttacaaaagcaatcatgctttcccaacagtgccctaaagtcttatttcagcattaacccaaaagtccacagtccaaagtctcatctgaaacaaggcaagtcacttccacctatgagcctgtaaaatcaaaagcaagctagctacctcctagatacaatgggggtactggcattaggtaaataaagccattccaaaggggagaaattggccaaaacaatgggtttacagggctcacggaagtccaaaatccagtggggcagtcaaattttaaagctccaaaatgatctcctttgacaccaggtctcatgtccaggtcacgctgatgtaagaagtggattcccatggtcttgggaagctctgcccctgtggctttgcagagtatatcccccctcctggctgctttcatgggctggtgttgattgtctgaggctttttcaggtgcacagtgcaagctgtcgatggatctaccattctgggtctggaggatggtggccctcttctcacagcttcgctaagtggtgctccaataggggcactgtgtcagggctctgatcccacatttcccttctgcactgccctagcagaggttctccatgagggctccgcccctgcagcaaacttttgcctgggcatccaggcatttccatacatcttctgaattccaggcggaggttcccaaacctcaattcttgacttctgtgcacccatagactcaacaccacatggacactgccacggtttggggcttccaccctctgaagcaacagacctagctgtaccttggccccttttcgtcatggctggagtgaccgggacacaggacaccaagttgctagactgcacacagcatggggaccctgggcccggcccatgaaaccattttctcctaggtctccaggcctgtgatgggaggggctgccatgaagatctctgacatgccctagagacattttccccattgacttggggattaacatttggctcctcatgacatgcaaatttctgcagccagcttgaatttcttttcagaaaatgggtttttattttctatcacattgtcaggctgcaaattttctgaacttttatgctctgcttcccttttaaaactgaatgcctttaacagcacctaagtcacctcttgaatgcattgctgcttagaaatttcttctgccagacaccctaaatcatctctctcaagttcaaagttccacaaatctctagggcagaggcaaaaagccaccagtctccttgctaaaacataacaagagtcacctttgttccagttcccaacaagttcctcatctccatctgagacacctcaacctggacctttttgcccatattgctacaggattttgggcaaagctattcaacaagtctctatagacattccaaactttcccacattttcctgtcttcttctgagccctccaaactgtttcaacctctgcttgctacccagtttcaaagtcacttccacattcttggatgtcttttcagcagcgccccactctactaatacaaatttactctattagtccattttcacactgctgataaagacatatccaagactgggaagaaaaagaggtttcattggacttacagttccacatgactggagaggcctcagaatcatggcagaaagtgaaaggcacttcttacatggtggtggcaagagaaaacaagaggaattcataagcagaaacccctgaaaaaccatcaaacatcatgagacttattcactaccatgagaacagtatgggggaaactgcccccgtgattcaaatgatctcccactagatccctcccacaacatgtggaaattatgggattacaattcaagatgagatttgggtggggacacagagccaaaccatatcaagtattgtttcccatgtcaaaatatttcttcttacatcagacaacttcactcatttatattacctgccaggtacctgtgagaacatgagtttgtgacttctgctgtatatatatagatatattctccaacctatcatagcaggtataccagaaatctgatcactagtgttaaacccacccttggtagtcaattctcatttacccaatcaacatgcaattacttttgatgtgttgaaagctttgtgtcagtgcacagctcagctccaatttaaagcttacattgtctgtagtctgtagttgtttttgtcttttttttttttcagagtctcactctgttgccaggctggagtgcagtggtgccatctctgctcactgcatcctccgcctcccaggctcaagtgattctcttgcctcagcctcccaagtagctgggactacaggcatatgccaccacgcccggctaatttttgtatttttagtagagatggggtttcaccatgttggccaggatggtctcaatctcttgatcttgtgatccacccacctcggcctcccaaagtgctgggattacaggtgtgagccaccatgcccagcgtttttgtcttttttttcttcccaaataacttttatgttaagaggtacatgtgcaggtttgttatacaggtaaattcagtgttacagggtcttaggagtacacattatttcatcaccaggtaataagcagggtaccctgatatgatttggctgtgaccccagccaaaatctcatcttgaattataattcccataatcctcacacggaccggaccaagtagaggtaattggattatgagggcagtttcctccatgctgttctcatgatagtgagtgagtcttaggagatctgatggttttataagcatttagtatttcccctgcttgcactcactctgtcctgctgccttgtaaagaacgttcctgcttctgctttgccttctgctatggttgttagtttcctgaagccttcccagcaatgcagaattgtaagccaattaaagctcttttctttataagttacccagtctctggtatttctttctttctttctttctttctttttttttaataaccttgcccaactggcttgttttattggagaaggggacgcggaataaacaacgtgagacagctgggacctgaggctgggaagaaccccctcccctccctatacatgcccactgccccaaataaaaaataaccaactatgggagagcaactgagacagccactgggggcagggaaaggagacactgaactcaagggcagctgtgaagagaccatgtatgtgctgagagggcccagaggcagcggcagcacgaacagcgcaggtacaaatctccgtgttttccctgggcttacgtataaatacagagaggtgaggccttctctccccctgctctcccttccgctccgtgctgcttgccgcggtccccgctcctctttccgcatgagggcgaagggaagcggggatggacaagtcattgtcgaattgcaatcagacccacatccatcagcttctggatcttctttgcgattacaggattctttaagtgttcgctgagtgcctggggggtccttctgcatctgctccaggataaggtgcatggctatgtcactcatgatctgctgcacctcggggtcggccatggctcgtcgcttcacatcttcggggctgtggtgccggttgtactgcgccatcatacagcgctggtagccgtctgccgcctccttacagctggagtccgggtctagcgccttccggtacacatccatgactttggtgtagtccttcatcgcttccagggcaacggctttccgtgtataacccttgatgaaggtcggttctagctggatacattcttcacagtccttgagtgccagctggaatccaggagtttggtgtaacaggcagctcgattgctgtataatttggcatctttcgggttccttttgatggcttccgtataatgcttcatggcgtggggatagtcccctttctgaaaacactcgttgcctttgttcttctcttctaaagccaggtcggggtttatgtaggccagccgttcttgctccttcaggattttctctgcctgctggcatttcttgagcacatctggagttcggtgctctgccagagacttgttatagaaatggatggcatccttgtacttttcttctttgaagtaggagttgccaattcgagcacacactttggcaatctgtagatagtcttctctgttttctctccccacttcaatggacttctcacaaagctcccaacacttattgtagtcgcccttttcaaagtataccgctgcttgattggtaatgtaagtcatgttgctggggtccagctccttggctttgtcgtaatgcttcaaggctgtcagtctttcttcttgtaggcatcgttcctcagctctttttctttcagtgcctgcttcttattctctggaagatcttcttccactggctctggcttggtctcctttttgggaaggggtggtggtgaaggtgttgcaacctgttcctcctcatccatactgccccgatcgacctcaaggaggacactgagagtggtcaggatccggggatctcgtagttttgtgcccagatcagaaggcttgttttatagttgctctatcagctcccggtaggtaggatcactgagcagtgtccttgtcctgggatcactctccaacttctgttacagattgggcatgttgaaagcattcatacattttctctctgccaacctggcctccatattctgtaaaccctctttcagttgagggttatctgcctcgtgttttaagctctcctcgtaggttcacttggcttcttcaaatcggtttaagaactctagagctgctgcttttcgtgaatatcccttgccccagtcaaacttttaggtcgacggtcttgcagccgtccttgtaagccttctggtagtctcctttcttggcataggtggcagaacagttgctgtagagcacgtggttgtggggatccagcttaatggcttcagagtagcactgtaaggcattgtcgatgttttccacgcccagggccttgttgcccttctctttcagctcattgacctgcttcatagcacagcgcggcccggaaccccgctgaatcgaatctgtccgctctgcgttcccaacccagtctctggtatttcttcatagcagtgtgagaaggaactaatacagtaaattggttctgaggtagtggggtgctgctatatggatacccgaaatgtggaagcaactttgcaagcgggtaacaagcagagattggaacagtttggagggctcagaagacaggaaagtgcgggaaagtttggaacttcctagagacttggagggctccaaagacaggaagatgtgggaaagtttggaacttcccagaaatttgttgaatggctttaaccaaaatgctgatagtgatatggacaattaagtccaagctgaattggtctcagatggagatgaggaacttatgggaaactggagtaaaggtcactcttgctatgctttagcaaagagactggtggcattttgcccctgctctagagatctgtggaactttgaacttgaaagagatgatttagggtattggtgaaagaaatgtctaagtggtaaagcattcaagaggaagaagaacatataagcttgaaaaatttgcagcctgacaatgcaacagaaaagaaaaacccctgcagatcacgaggtcagcagataaagaccatgctagccaaaatggtgaaaccccgtctttactaaaaatacaaacattagccgggcatggtggtttgctcttgtagtcccagctacttgggaggctgaggcaggagaattgcttgaacctgggaggcggaggctgcagtgagccaagatcatgccactgcactccagcctgggtgacagagcaagactctgtctcaataataataataataataaaataataataataataataataataatgtagtaataataaataataatttaataataataaattcctggaaatagataaaccaagaagaaatagaaactctgaacagaccaataacaagcagcgagattgaaattgtaattaaaataaactgccaaaaaaaaatccaggaccagatgcattcccagctgcagtctatcagacattcaattaaagattggtaccaatagtactgaaaccatttcaaaagatacagatttacggagttctctccaaatcattctatgaagccagttatcaccctaataccaaaaccaggaaagacataacaaagaaaggaaactatagaccaatatctctgataaacatagatgcagaaatcctcaacaaaatactagctaactgattccaacagcgtatccaaaatatattccaccataatcaagtgggttttacactagggatgcaggaatggtttaaaatacaaaagccagtaaatgtgataaaccacatagacagagttaaaacaaatatcatataatcatctcaacatatgcagaaaatgcatctgacaaaatccagcatcgctttatgcttaaaaccctcagcaaaattggcatagaagggacataccttaaagtaataaaagccacctgtggtaaagccacctttggtaaacccacagccaacattatactgaatggggaaaagttgaaagcatcccctgtgagaactggaacaagacaagaatgcccactttcaccacttatatttaacatagtactgggattcctcagacaaaagaaagaaataaagggcatccaaaatggtaaagagataaactgtcactgtttgctgatgatatgatcatatacctgaaaaaccctaaagactcatccaaaaagcttctaggtgtgataaatgaattcaataaagtttcaggatacaaaatcaatgtacacaaattactagcactgctatacaccaatagcgaccaagccgagaatcaaatcaagaactaactcccttttacaatagctgcaaaaaatatataaaatacttaggaatacacctagccaaggaggtgaaagatttctgcaaggaaaactgcaaaacactgctgaaagaaatcatagatgacataaacaaatggaaacacatcccatgctcatgaatgggcagaatcaatgctgtgaaaataactatactgccaaaagcaatctataaacttaatgcaatttccatcaaaataccatcatcattcttcacagaactagaaaaaaatcctaaaatacgtatggaaccaaaaaaagagcctgcatagccaaagcaaggctaagcactgagaacaaatctggaggcatcacattacctgacttcaaactatgctacaaagctctagtcaccaaaaaacatggtattggtataaaaataggcacatagaccaatggaacagaacagagaatccagaaataaagccaaatacttacagacaactgatctttgacaaagcaaaccaaagcataaagtgggaaaaggactacccttccaacaaatgatgctgggataattggcaagccacatgtaggagaatgaaactgcagggtcatctctcaccttattaaaaacaacaactcaagatgtattaaagactcaaatctgcgacctcaaaccatctaaattctagaatataacatagaaaaaactcttctagacattcgtttaggcagagagttcatgaccaagaacccaaaagcaaatgcaaccaaaacaaagataaatagataagaccttattaaattaaaaagcttcttcacagcaaaagaaataatcaacagagtaaacagacaacccacagagtgggagaaattattcacaaagtatgcatctgacaaaggactaataatatccagaatctacaaggaagtcaaatgagcaagaaaaataataatcacatcaaaaagtgggctgaggacatgaatagacaattctcaaaagaggatatacaaatggccaacaaagatataaaaaatgcttaacattactaatgatcaggaaaatgcacatcagaaccacaatgtgataccaccttactcctgtaagaatggccataattgaaaaataaaaaaaaatagatgttggtatggatgtggtgaaaagggaacacttttacactgctgatgggaatgtaaactagtgcaaccactatggaaaacagtatcaacattccttaaagaactaaaagtagatctacagtttgatccagcaatcccactactgggtatctacccagagaaaaagaagccattatatgaaaaagccacttgcacgtgcatgtttatagtagcacaatttgcaattgcaaaaattcggaaccagcccaaattcccgtcattcaatgagtggataaagaaattgtgatatatatatatatacaatactatatatatatatgtatatacacacaccatactatatatatatatacacacacacacacacacaccataccatatacatatatatacaccataccatatatatatacacacacacacacacacacacacagacaccatggaatactactcagccataaagaggaaagaaataatagcattcacagcaacctggatggggttggagaccattattctaagtgaagtaactcagattggaaaaccaaatattgtatgttctcacttatagatgggagctaagctatgaggacgcaaaggcataagaataatgcaatagatgttggggacttgggggaaagtgtggaaggggtgtattagtctgttctcacactgctataaagaactgcctgagactgggtaatttataaagaaaagaagtttaattgactctcagttccacatgactggggaggcctcaggaaacttacaatcagggtggaaggggaagcaggcacatcttatgtggcagcaggcaagagagagagagagagtatgtgagagagagcagggaaaactgccttataaaccatcagatctcctgagaacttacttgcgatcatgagaacagcattggggaaactgcccttatgattcaatcaaccccctccctggacacatggggattacatgtcccttgctcaacatctggggattacaatttgaaatgagatttgggtggggacacagacccaagacaatcaagggggccgagggataaaatgctacacattgggtacagtgtacactgcttgggtgatgggtacaccaaagtctcagaaatcaccactaaagaattatctatgtaaccaaacaccgcctattcttcaaaaatgatagaaataatattttttaaaaattaaataggccgggcatggtggctcatgcctgtaatcccagcactttgggaggctgaggtgggcagatcacctgaagtcaggagtttgagactagcctggccaacatggtgaaaccctgtgtctaccaaaagtacaaaaattagctgggcatggtggtgggcgcctgtaatcccagctacttgggaggctgaggcagaagaatcacttgaacccaggaggcggaggttgcagtgagctgatattgcaccattgcactccagcctgggtgacaagagtgaaactctgtctcaaataatactaatactaatactactactactactactaataataataataaatcattcaataaacttgtgattgcattttgaagttattgtagtgagtttttcagctctgtcagatcagtttggctcattctcaaaatggctatttcatctttcagcttctgtatcattttattggattccttagaattcttgtattgggttttgactttctcctaactctcgatgatctttgttcctatgcagattgtaagttctatgtctttcatgtcagccatttcggcctggttaagaactattgttggggaccagtgtggtcatttggaggtaagaagacactctggatttttgagttgccagaggtcttgtgctggatcattgtcatctgtgtggggtgatgttcctttaatctttgaaggtgctctcctttggatggtgttttttggttttatcttctttgctgcccttgagggtttgattgtggtataaggtggattcagtcaactggctttattttttttttgaagatttcaggggcccaaggcccagctcagcagtcctggccttcatgttgtaaccctgggcaggttacaactgggcccctggctttgttctctggcccctaaagattaggaacctgctgtgctggaagggcctaggtgttcctggtccactggcaagaacactctgatggggtaatggcagagagtttcatccttgcttgtgcatatcagcagcagtggtgttggctctgttttctaagacatgaaaaaattagggggaatttgtttaataatacaacctttctataatcttgaaaattaaaactaaaattaacaaaaagaattgataatttccaaacttctaaaattagcaaaactcctttaggaattttaccatacattttatcacaatgtttcataaagctaaagcattaatgtctcccaaatgcaatattttaacttggactttttaaagagaaacaacttttaaaaagccataaagacatcatatgaactcagctcttacaaatgtggattgttgaagacgatacttactttaaactcataagggatataaataaatataaaactttagtacccaggacatgaaaaccagaatgatgataaacgtaggttccatattaaacatcatgtttccagttctttcaggaacaatatatttatctagtttctaaattgagaaaaggaagtaaaaaggagaggtgaattatgaaaaaagcatgttatcagtgttctcctttagattgtttttgaaagcttttaaacactgggtgtgtaagttaaagctgcttttagcacttcctcaacagatcaccttagattttgctaaacttggcaccattataggggtcatattttcacacggatgcactcttcctgaacagaatgtatttgacagaaacaagtttttctttcattccaggcatttgtgtgtttgctttttataacaaacagtaagacaaagctcaccattttggactctctcccaatatttccaatttagctatgaaaacaagatttttatttcatggtttggagaagtgcactttaaaagttaactctttaagagcacacaggattttttcctcaaaattcattttatattctttgatttgaattttgtttgcacttctttggatatcacaaagtctagcctctcatcacatgagttggtaagggagatattttcataagtagtcttttttttaaccttacatgatttaacgttttactatagttctttttttaatatatatttttgtttgagatgctaaatctggtctccataatcagatttgggagcagcctttattttgttgttaggtttttggcagagtctagaagtccccaagctgccaaagttttgtctgaaagccttttgagttcagcagttttcatactctatcctgtcataatgagcagcatctgccccccaaaaaaggccaagttattatgacaggttagaatcttaatagtattaggaaaaaatcttgcaaggttatatctagaatatgtattcaaatgaaccacaagcctaattccagtggttgcaaggacagcacgtcatgcagcctgtattcccagtcttccatagaagtcaaagcatccagtgaaaattctgacactgaaagaatgtctattgaattcttcattctgaagcaggttataagaaggagatttgctgggcatggtggcttacacctgtaatcccagcactttgggaggccgaggtgggtgaattgcttgagcccaggagttcaagaccagtctaggcaacatggaaaaacgctgtctctacaaagcatacaaaattagccaggcacagtggtatacacctgtagtcccagccaattgggaagctgaggtggaaggatcaactgagcccagcagttcaagactgtagtgagccatgatcacgccaccgcactccaacctgggtgacagaatgagaccctgtctcaaaaaaataaataaataaaaataaaaaaggaggctggcaagaagacctatttttaaatggacacatttcttttaggaagagaaagaaatactattttttacttgtaaaagaaaatgggtaaattaaaatgtgactgtacttgatattttcactgaatgtaattatcgtcatcatcatcaccatgatctttgtaagcctaaatgacttatttggaagagaatgttagtatattttacatgtcatcttagttctttattgtcatgctttcctttttaaaatttgctttctttagcctctgaaccattcaaatatgctattatcattcttttcagttcataggcctacattatttactgttcaaatataatataacactagaacagctatttgtgctgaaatatatttcaccatttttaatgggagaaaagattatcaactttcctataaacagagaactgatatacagaggtattagttcattccatagcacataggagtgctacttgtacacaaaatgaaatatcaggaaatgttaatgcatgtactgttctgtgtaacttcagacttcatcactaaactaatgaaagagtatcttgaatagtcgttcaagctagatacaaatcagttgctgaaaataagaggacaataaatgaaatattagatagagatttgcaaaagcaccataataatttacattactggaatatgagtagaaatgtatttttagtctcttattctcaaggtttgatatgctaactataaagcaaggatgacacttcatgaactggggcttcttagtgttcacaaatgtgtgtgtatgtgtagcttttaatttttagtttgaatacaaaactgaactttgttgcacatgtataaaaactctacattttttaggtcattcagcctgaggaaaaagttatatcaacagaagagcaacaaaactaaatttttctgacacttcttgtatcgctattacaggacctctctatttaattcaagaagttcagaaagaaaggaaagaggtggtgtcttttaaatagaaatgtcttttatttctatttttgtctagctaactcctattcatgtatcaatgcctagctcaagagacggtttctttggaaagcctttcttaacccacattctatttaggtagcccatctctacacattcataaaaccctatgcctgtttcctgcttttcacagtactgattatggaattataaccattgggttactcattagctgtcttatgatctttctatcatttcgctcctctatttcctcctctcttccttttttctcattcctaatctcacacccgtacacaagaccatgagttcctcatgaacaaagactgctttactgggctttgaatttctagcatttagcgcaatgtctggtacatagtaatgaccaaccaatatttattgaattaacatatataagtgaatgaatgcttaggaactagtcatatcagctgtgaccatttttgtcttttcctctagattggtaggataatatactctgttgcagctaatgatcactgtgttagtttgatagggctgcataacaaagtacaacagactggttgtttttaaaaaataaatagaaatttattttctcactgctctggaaactagaagtctgagatgaaggtgttggcaggattggttccttctgaagatggtgtagaaagaatctgtttcagacctctttccttgttttgtagaagtctgtcttctccctgtgtcatcatcttccctttggacatgtctatgtccaaatttcctcttcttgcagtgacatcagctatattggattggggcccaccctagtgaacccaattttacttgattacctctttaaagagtctatcttcaaatacagtcacattctgagatactaggagttaggagttcgacatataaattttggggaagacataatccagctcataactcctaagggtgctgctcttagtaataaccatattagtaagcaaccatttttgagcacatattttatgctcaaaaacagtgttagaaacagtattagttttgtttcagaaacagtattaagtattttatatgcacatctccgacacgtaaggttgccctgatgtctgccacaggctcctgcactcatgaacccatcgaagcaccaatattttgtcacccatcctgtggttcagtagttaactgcaatggagaaaatttctctttacttccactggtgtgacgccttactaagtggggtgctaagtagtgctactttttcttttttttttaacgtggattctcagctgcccaggctggagtgcagtggcaagatctcggctcagtgcaacctccgtctcccgggttcaagcgattctcctgcctcagcatcccgaatagctgggattacaggcgcccgccatcacgcttgcttatttttcagtatttttagtagagatggggtttcaccatgttggccaggctagtctcatactcctggcctcaagtgatccaccggcctcagcctcccaaagttctgggattacaggcatgagcctccgcacccggcctgagtagtgttactcttaaggatctacaaaaagtttattgaagcagttcttttactttttattattttattgcattcttcatgtatgaaacttcaaccatgggtccacaggagttgagtcgggggaccaagttgaatggcaagttacaggctctattcagaattatgccattttatccatgccctagtactgcccttgtgtgttttgattccctcttctttcggtttaaattttcccctccccgcaggacttaaatataatagatgcagagccaatccacctccatcatccctccagacgtgcatggtttctagaaaatatacaagttctcaactgagatctcagctaaatttagctgcaaactgagttttcactatgcttttctaagaaattttactcatgtaattgtttcttgttgtcttgtcttctttcttttttaatttaaaaatatttaattgacaaataaggattatatatattcaaagtgtgtgacggggtatccaatcttttggcctctgtgggccacactggaagaagaagagttctcttgggccacatataaaatacactaaccatagctgatgagctaaaaaaaatcacaaaaaaaatcgcataatgttttaagaaagtctatgaatttgtattgggctgcattcaaagccatcccgggccgcatgcggcccaagggccatgggttggacaagcttgatgtacaatgtgatgatttgatatatgtaaatattgcataatgaaagaaagacagtgaaaagagaaagaacctcaaggattcatgtcgtctgttttttttttagcaagattatgcaagtgtctatattataggcatctaagagcattagtagtgcctatttttcctccttttgtgaaaaaaagagcacaggagtagtggaaaaagaaaggagttgacacatgaggtaaaataatctatactcttctctcttttagaggtgttagaaagatctatagctgtatcttctccaaggtcaagtcagggcttgtggtggaatacattctacctcagctcctccatacactgatgacagtatcctgcattcagggccatggaaaggttgacttactcaatctcaccatgtgagtagcgatagacttccccagcaattttattcatctagctgaattctttctaaagactattttggaaattcaatttctagagttttgaaaaatgaattccaaatatcacctgaaggctttgtttattttaacaattgagatcaatagggaaaagatagagtttaaaatgatttcccattctatgaatgttcctccatatgattcaagtagcacctagtatttatcataattttaaatttaattggcaacatattttattgtcctttagtattgtggttcattaatactatcaaaacctttcaagccagattaccaaaatcttggtgacttttattgccagaatttgagagtttgtttcctccaatcttcaataatttcaccctctatttagtttaccaaagcctgttaaattgctgttctcgtaatgtcaggaggaatttcacatctctttgcagaattaaacttattgagttggtgtttcacatgccagatctatctatctatctatctatctatctatctatctatctatctatctatatatatatatatttatccctggggattgcctattcacattagtaggagctgagtagacatatcaagcaaacaacagccctctcttcacttgacaatcaggtagcaagggtacagttatcagtgctagtaatattacatctccagaagaatttaaaggatcactttcaattatgggtagagctctaagcttgataggatattacagagctgaactatttatagaatcacaaatcccttcacaaacattttggaaattgatgtttacatgttagcactattataaaaatgtattttttaaatgtatgcaattaaatttttttgccaagaatgttaaaaacttgaaatcattgtggaaagcaaaaaagtccatagtatgtgttccttaatagaaggcaacacagtacttttttgcctggaattctaatttgcaaatccaatgtctctctccagataaatgcaatgtaatataactcgtaccagtatgtaatatgccagttaggtgcccccaaaaagatctagatctgtaaatagtgcttgaggaccaacaggatttctttgtggttttatgcttgacactattagcatttttcatagattgaaaatgctttattagatcttaaatctttctaacaatattacctaatatctataggtaaattgtcatgtttcccaagtgacaaaaaaggggggcattattagaaagaaagcattaccaaattttctgttttggatagattcatatatattatatgagtaatcaataatatataattaaatacattataattacataaataaatcaatccaaatatatatattttcgtcagtcttaatttttttctaaacaataagccaaaccctatgtatgccaggtacaaagcataatttggaaatttcaccagtcagtgcttttccatgccattattgggagcattatgcttctagctataaaacaaataattaaaatccaagaagggttatgtaatgagagtatactcaaagtgtctgatgggaaagaaaatgacatgtaaaaccctatgtaaataaagtaatcctttaatattctatgtagatactcatttgagacaaataactttgtacaaagatctattttttcaaatattgtctgcttgaatggcttttgatgatcccaaaagggaactgtagatagacctttcttgcaagtggattactgcttctgctgtactgagagtctggatacatgcacaggtattactggtaagaattaaatctaaaaggggctgccaactagcaaggttctactttgatcacatgctgagtacatatgaagccattgaaataatcattagtcttgaaataaggatgttgtgcctgcattccttcaccccaacataagcatagctgaatatttggaagattgttttaatatagcaagctatagagctgcaaatcgttatttttgtggtgacctgaatctctttacatcattgtccttgagacatttatttttagtatcttctatgttcttaaataaggtgcaatagctccagtaagtaatctaaaatgttgtcatttattgactttttgtaatgaaaataactaaaattcccccaaataatttcttttacatgtttacaggaagatatgaaaagtaaacacttaaatagcttttttattaacatttaaagaaaattaatacttcttatttgactcagaattaaacaaattcattattctttttttttttttttttttggagatggagtttcactctttttgcccaggctggagtgcaatggcacgatcttggctcactgcaacctctgcctcctgggttcaagcaattttcctgcctcagcctccctagtagctggtgttataggtgcccgccaccatgcccagctaagtttttgtatttttagtagagacagggtttcactatgttggccaagctggtcttgaactcctgacctcaggatccacccgcctcagcctcccaaagtgttgggattacaggcatgagccaccatgcccggctccaaattcattattcttgaaaaatatagagaatatagtaattgtcaaatttcttttttaaaatgtgaaattgatgacaatgacagtaattccttttatttgctcagtttctatccaaatgttaatttaaggaatgtagataactttggtttataagagcattgaacaatgaccagcaatccagtggaatgcatttgttacttttacaagttttcttttttttctttctttttttttgcagacagtgtcttgctctgttgcccaggctggagtgcagtgacatgatctcggctcactgcaacttctacctcctaggctctagcaatcttcccacctcagcctcctgagtagctgggactacaggtgtgtgccaccatgcctagctgatttttctagtctttgtaggacggggtttcatcatgttgcccaggctggtcttgaactcctggactcaagcaatccatataccttggcctcccaaagtgctgggattacaggtgtcagccaccatgcccagccaacttttataagttttctgatataaaacattgcttagtttatcatccattttctcatcaaaatcattcctaaccatgctgagcaaaatagaggatagagctctgtggcacaatacagagactttatttgtagttgatattgatccattaattagtattcacccaatatttcagctactattcttcattttatctataaaaatgtacctagaaatgtggatttgtgctaattcatctgatttataaaaattcagataatctatgccttcaatattcctgtttttaccacttggtagcttcctgttaatctttctagagcttttatgtgcacatacagaatatgcacatatgtgtctatctgccttcctttctttttacacacataatagcacactatgtaaataatagcgtgctatgaaactgctttgcatgttgccttttccacaaaatatatcttggactttattctggaaaatctagatctgccacatttttaaatggcttcacaacattgtgattgcacagatgtatcataagttattttgtcagtttcctattgatagacatttacattgtttccagttgtttggtaatgcaagcaatctttagtacctatccttgtacatacttcttggtgcacatttataataagacttatgcaagaaaactctaaaagtagaattgttgagtgaaatcgtactttaaattctgagagatcttgttaaaatgtgttcaaaccaaaaatttatgagagtgcctgattttctatactttatctcgtctgcatttgtgggcctctcattgttataagttttttcttatattgagttataatctatttttctataatttcccccatttatactagtactgacctctggatttacacataacatattaagtccctctcacatataacaagtctttaagcagttaaagagcgtcctcaaggtttgcccaaggttcatctccagattttatgctctgtagtggaagtttgcctgttggttgtcagatttatcccttgaccttcccctgttttgctctgaaatggaagggggctaacacatgaggttatgttttctaggctcatgttggctgacttctgactgagtttgccaaagtgagacactgcaggaaattggacagaggaaggatctagtgatataagtatttatctcaagaaactaggaagggactctgggcagatcaacatggcaaaatagaaggctccactgattatgtccccacccctgccccctcccccacaatgacaccaatttaacaactatctacacaggaaaaacattttcataagatccaaaaatcgcctgtaatcgcagcactttgggaggccgaggcaggcggatcacgaggtcaggagatcgagaccatcctggctaacatgatgaaaccccgtctctactaaaaacacaaaaaattagccgggcgtggtggtgggcgcctgtaatcccagctactttggaggctgagacaggagaatggcatgaacccgggaggtggagcttgcagtgagccgagattgtgccactgcactccagcctgggtgacagagccagactccatcacaaaaaaagaaaaagaaaaagaaaaaaaaagaaccaaaaatcaggtaaccaatcatagtgcctggttataactttatattgctgaaagaggcactgaagggatagaaaaaataatcttgaatcctcaatgccacccctcccccaccccaggcagctgtggcttggtgcagtgagcctccttgaccactgtgagagacacagcaattgtgaagcactgaactcgctgctgtcctgttagagcacaaagaaaaaccaggccaaactcagctgatgcctgtccatgaaggaagcatttaaaccagtcctagccaaaagggatttgccaatcccagtgatctgaacttgaggactcacaaacctcactgctaccaaggaccaaagtgctctcagactctaagtaaacttgaaaggcagtccaggccataaggactgcaactcttaggtagtcttattgctgaactaggcccagagacagtggattggtgggaaaggaaggtgagacatactgagacaccagctggggcagccaagagagtgctggcatcaccccttctttaactccagtttgcatacctcacagctccaaaaaggccccttccttccacttgtggaaaggagaaggaagactgggaaggactttgatttgcatcttggatgccagatgagctacagtaggatagggcactggttagagtcatgaggcccccattccaggctctagctctcaggtgacattgttagacacaccctaggccagaagggaacctgctgccttgaaagaaaggacagcgtcctgaaagcattaattacctgcaaattgaagagactttaggactcaaataacaagcaacaatactcaggtactacattgagggccttgcgggatcctctgagacctgctggcttcagataagactaagcctgttatcagctgtgttggctattgggcaaaactccctctgcttgagaaaatcagagggaaaggaaaggggactttgtcttgcaccttaagtacaagcacaaccacagggatgtagagcacaaagtgggcttttgggggtccccaattccagaactttgctcttagatggcatttctagacctgccctgggggagagggaagcccactgccctgaagggtgagttccagtcagtcagcattcaccacaagctaacttaagagccctaaggccttaaaggaacatcagtggtagtctggcagtactccttgtggcatggggtggtggtggctatgaggtgaggcttctatgcctttggaaaggggaagaaagagtgggaaggatggtgtcttgtgatttgagtgccagttcagccacagtacaatagaacaccaggtagattattaaggtttttgactcctcttcctgaatcccaggacagtaactctgaacccacctaagcctgggggacctcaccaccctgaagtgaaagacccagaccttgatggttttgccatctgctgattgtacaacctcaggcccttgagtgaacataggcagtatccagggagttattacagcagagcttacagccagtggttacaacactgggcaagacccagtgctgtgctggcttcacatgtgacccagtgcagtcatagtggtagtagcctcaggggtgcttatgttactccacccacagcattaaatggctcagaacagagagagactctgtttgaaagaaaaaaaggaacgaggacaagagtctgcctggtaatccatataattcattcagatgttgtccaagaaaatcaaagtggcatctctatgagtctgcaagaaccacaatgttactgtgcttggggtacaccctaaagtatatacagcttagatcacaacacacgagtctcttcaaatatctggaaagccttagcaagaaggaggactacaaataagttcagacagtgaggactgcaataaataccttacacttcaatgcccaaacaccaaagaatatctaccagtatcaataccatctgggaaaatataaactcacaaaatgaactaaataaggcaccaaggatcaatcctggagaaagacagatatgtaactatttggacagagaattcaaaatagctgtgccgaagaaactcaaaaaaattcaagataacacacagaaggaactcagaattctatcaaattaatttaacaaatagatgacaataatttaaaagaattaagcagaaattctacagctgaaaaatgcaagtgacacaatgaagaatgcatcagtgtcttttagtagcagaattgatcaagcagaaaaaagaattagtgagcttcaagacagtataattgaaaagcactttctagatcctgttgatgtgcttctttgttttttcttatttctttcatatcaggagaaaaacaaagaagcacaccaaaaggatctagaaaatggcctcaaaaaggcaaatctaagagctatcggccttaatgaggaggtagagaaagaaataggggtagaaagtttattcagaggataatagagaatttcctaaacctacagaaagatatcaatgtccaagtacaagaagattatagaacagcaagcagatttgacccaaagaagattacctcaaggtgttgaataatcaaactccccaagatcaatgataaagaaaggatagtaaaagcagcaagagaaaagaaacaaataacatacaatagagctccaatatatctggcagcagactctttgttggaaaacttacaggccaggagatggtggcataacatatttaaagtgctgaagaaaaacaacttttagcctagaatagtatagctggcaaaaatatccttccaacatgaaggagaaataaaaactttcccagacaaagaaaagctgcgggatttcatcaataccaggcaggtcttacaagaaatgctaaagggagtacttcaatcagaaagaaaaggatattaatgagtaataaatgatcacctgaaggtacaaaactcactggtaatagtaagtatgcagataaacatggaatattataacactgtagctgtggtgtgtaaactgctcttatcctaagtaggaagattaaatgactcagcaataaaaaataataactgcaacaaattttcaagacatagtacaataatttgtaaatagaaacaataaaaagttaaaagtaaggggacaaagttaaggtatacaatttttattaattttgtttttgcttgtatgtttgtttatgcaaagagtgttacgttgttatcagctaaaaacagtggtttatatgatagtatttgaaaccttcgtggtaaccacaaaccaaaaaacatacagtgaatacacaaataatgtaaagcaagaaagtgaatcatatcaccagataaaatcaactttactaaaggaagacagaaaaaaaaaaagaaaagaaaacaattaaaatggcaggagtaagacctagtcagtacaataatatataaatgcaaacaacaaaacattaaaaagttactgggtgtggtggcttatgcctttaatctctgcacttagggaggccgaggcaggcaaattgctgaaccctaggagtttgagaccatcttgggtaacatggcaaaaatccatctctacaaaaaatacaacaattatccaggtgtgatggtgtgtgtctgtgatcccagctatttgagaggctgaggtgaaagggtcaattgagcctaggaggtgaaggttgcagtgagtcaatcttctgccactacacttcagtctgggagacagagcaaaaccctgtctcacaaaaaaaaaaaaaaaaaaaaaaaaaaaaaagaaagaaaaagaaaaaaagaaacgataaaaagcaggtggacaaagaagttaagccatagactttttattagtttgttttttacttgtttgtttgttttcttatgcagacagtgttgttataaggttaaaatatgggttattggtagtatttccaagcctcatgataaactcaaaccataaaatatacaatggatacacagaaaatataaagcaaaaaactaaattacatcgccagagaaaatagccttcaataaagcatatatataaggaaaatattatcagagctaaatagagaggccacaattaaataatagctggagacttcatcacaccattttcaccattggacagatcctccagacagaaaatcaccaaaaaaaaaaaaaaaaaaaatcagacttaatctgcactatagaccaaatggatctagataattacagaacatttcctccaacaacttcagaatacatattcttttcttcagcacatggatcgttctcaaagatcaaccatatattagggcacaaaacaagtcttaaaacgttcaaaaaattgaaataatatcaagcatcttctctgaccacaatggaataaaactagtaagtaataacaagaggaattttggaaactatacaaatatatggaaactaaacaatgtactcctgaatggccagtgggtcaatgaagaaattaagaaggaaattgaaaaattccttgaaacaaatgacatatcaacagaatgaaggataaaaactatgtgatcatttcaattgatgctgaaaaagcatttaataaaattcaacattccttcaggataaaaactctcaaaaacctggggatggaaggaacgtgcaccagcataattaaaaccatataaaacagagccatagctagtatcatactgaatgtggagaaactgaaaacctttcctctaagatctgagatatgacaaggatgcccactgtattagtccattttcacgctgccataaaaaacttctcaagactgggtaatttataaaggaagtaggtttaattgactcacagatctgcatgactggagaggcctcaggaaacttacaatcatagcataaggcacctcttcatagggtggcaggagagggaatgagagccgagtgaaggaggaagccccttataaaaccatcagatcttatgagaactcagtcactatcatgagaacagaatggggaaaactgcccccatgattcaattatctccacctggtcttgcccttgacacattgggattattacaattcaaggtgaaatttgggtgaggacacaggcaaagcacataattttgcccctggccctgcccaaatctcatgtccttctcacatttcaaaacacaatcatgccttcccaacagtcccccaaagtcttcactcatcccagcattaactcaaaagttcaagtccaacgtctcatctgagacaaggaaagtcccttctgcctataagcctgtaaaatcaaaagcaggtcagttactttctagttacaatgggggtacaggcattgagtaaatacacccaattcaaatgggagaaattggccaaaacaaaagggttacaggccccatgctatctgaaatccaatagggcagtcattaaaccttaaacttccaaaataatcttctttgactccatgtctcacattcaggtcacacggatgcaaaaggtgggaacccagagtcttgggcagctctgactctatggctttgcaaggtacagctccactcctggcttctttcatgggctggccttgagtgtctgtggcttttccaggcacactatgcaaactgtcggtggatctactgttctgggtctggaggatagtggccctcttctcaaagctgcacaagacagtgccccagtggggactctgggtaggggctccaaccccacatttcccttctgcattgccctagcagaggttctccatgaggactctgccctgcagcaaacttctgcctggacatccaggcctttccatacatcctctgaaatctagccagaggttcccaaacctcaactcttgacttctgtgcacctgcaggcccaacaccatgtggaagctgccaaggtttggggcctgaaccctgtgaagcaatggcctgagctgtatgttggcttcttttagccatggctggtgctgctgggatgcagggcaccaagtcccaaggctgcacacagctggggggcctggaccttgcccacaaaaccatttttccttcctaagcctctacgcttgtgatcggaaggtctctgacatacctggaggcatttccccattgtcttgatgattagcatttagcacctcattacttatgcaaatttctgcagccagcttgaatttctccccagaaaataggtttttcttttctatcccattgccaggctgaaaatttttgaaacttttatgctatgcttctcttgaacattttgctgcttagaaatttcttctgccggataccctaaatcatctctctcaagtccaaagttccacagatcttagggcaggggcaaaaagccaccagactatttgctaaagcatagcaatagtgacctttactctgttttccagcaagtttctcatctccatctgagaccacctcagcctggacttcattgttgatatcactattggcattttggtcaaagccattcaactagtctctaggaagttccaaaccttcccacatctttctggcttctgagccctccaagtctctaggaaactccaaactatcccacattttcctttcttcttctgagcccttcaaactgttccaacatctgcctgttacccagttccaaagtcacttacacgtttttgggtatctgcatagcagcatgccactccctgtggtaccaatttactgtattagtttgttctcatgcagctgtgaagaaatgcctgagactgggtaatttataaagaaaagatgtttaattgacacacagttctgcatggctgggatagcctcaggaaacttaaaatcatggcagaaggcaccttttcacagggcagcaggaaggagaatgagagccaaatgaaagaggaagctccttataaaaccatcagacctcattggagctcactcactattgagtacagtgtggggaaacaatccccatgattcagttatctccacctggccccacccttgacacgtggggattattacaattcaaggtgagagatttgattagggagacagagccaaaccatatcacccactgtcaccactattatttaacatagtactggaagtcctagctgcagcaattagacaagggaaagacataaatggcctccaaattagaaaggaagaagtcaaattatccttgtttacaggtgatgtaatcttgtatttggcaaaacctaaagactccacaagaaagctgttagaactaataaattcagtaatgttgcaggatacaaaaccaacatacaaaaatcagtagcattttcatatgccaatagtgaataatatgaaaaaatgtaatttcatttacaatagccatacataaaattggatacctagaaattaacttaaccaaagaaatgaaagatctctataatgaaaactataaagcactgatgaaaaaaactgaagaggaaaagaaaaaaaaaattgaagagaagaccaaaaaatggaaaaataacccatgtacatggattggaagaatgactattgttaaaatgtccatagtatcaaaaccaatctacatgttcaatgcaatccttatcaatgtatcagtgacattcttcacagaaatagaaaaacaactttaaatttatatggaaccacaaaatatccagagcagccaaagctatccaaattaaaaagaaaaaaacctggaggagtcacattacctggctgcaaattacactgcagagctataggaactgaaacagcatagtactggcataaaacagacacataggccaatggaacagaatagagaagacagaaaaaaatacacacaactacagtgaactcatttttgacaaaattgctaagaagatccactgggggaaaagacagcttcttcaataaatgatactagaaaaacgggatattcatattcagaaaaattaaactggacccctctctctcacctcatacaaaagtcaaattaaagtgaattaaagacttccatctaacacctcaaactataaaagtactacaagaaaactttggggaaaatctccaattcattgatctgggcaaaaatatattaaacaataccccataagcacaggcaaccaagcagaaatggacaaatggaatcacatcaggttaaaaagcttctgcactgtaaaggatacaatcaacaaagtgaagagaaaactcatagaatgggaaaaatatttgcaaactgctcatctgacaagggattaataaccaggatatatagagagttcaaaaagctctgtaggaagaaaatctagtaagctgaacaaaaattgggcaaaagatttgaatagacctttctcaaaagaagacatacaaatggccaaggtgctcaaaaccagtgatcatcagagaaatgcaaatcaaagctgcaatgagatatcattgcaccccagttaaaatggcttatgtccaaaaagtgggcaatgatacatgctggtgagaatgtggggaaaaagtaacccttggacaatgttggtgggaatgtaaattactacaaccgctatggaaaacagattcctcaaaacactataaactgagctaccatgtgatccagctatttctctgctgggtatatacccagaagtaaggaaatcagtatattgaagagatatctgcactcctgtgtttgttgcagcactatttacaatagctaagcttgggaagcaacctacatgtctatcaagagatgaatggacaaagaaaatgtggtacatatacacaatggggtactcttgagccataaaagaatataagtgaataagtaataaatgaataagcggataagagaataagcgaaataatccaggcacagaaagataaatatcacatgttctcacttaagtatgggatctgaaaataaaaacaattgaattcatgaacagagagagttgaagggtggttactggaggctgggaaaggtagtgggggctgagggagatgggaatggttaatagaaaatggaaatagaaagttaatagaaaataaaaaatagaaagaatgaataatacctactttgtggtatctcaacagggtgactatagtcaacaatatttaattgtacattttaaaataacttaaggtatgtaataggattgttcaaaacacaatggataagtgcttgaggggatggataccccattctccatgatgtgcttgtttcatattgcatctttgtatgaaaacatcttatgtaccccataaatatatacacctgtctatccttataaataaataaataaaaataaataaataaactaggagaagaacaaattctacctaattaaaggtgatggaaaataataaggataaaggcagaaattaattaaagagaaagaaaacatttaatagagtaagagtacaagcttaaatttagttctttggaaagactaatataattaattaactcttggcaaaactgatcaagacaaaaaaagataagacacaaattgccaacatcttgggtgaaaagagggataccactgagattctacagatattaaaaagataagagattgatttaatcttatgacaataaattcaattttagataaaatagaaaacttccttaaaaaacacaatttaccaaaactatcacaagaagtataacatttgaataatattatatctattaaagaaatcaaatttgtaattaaaaactttcccacaaagaatagtttagcctcagatgatagtaaatttcttcaaatatttaagagagaaataacatccatgtcacacaaattcttccagaggatagaaaaggaaggaatgtttctgaactcattttatgtgattataataacacttatgagaaaatctgacaaggacataataagaaaattaaaggccaatctccttagtggacataaataaaaatttttattatttattataaaattgaatccagtaataaaatgaacaatcgtcatgatcaagtttggtttcttctatgaattcaaaggtgatatgatatttttgaaaataatttaattattatatcaaagttttgatagcgttagtttcatgagtgctctctcatcctatggtatatttaaagtattttttaagaaaacaccttaacatggctgagtgtggtggctcatacctgtaatcccagcattttgggaggccaaggtgggtggatcacttgaggtcaggagtttgagacctgcctggccaacatgatgaaacctcatctctactaaaaatacaaaaattagccagtcgtagtggcggacgcctgtaatcccaactactctggaggctgagacacaagaattgcttgaatccgggaggcggaggttgtagtgagccgagatcataccactgcactccagcctgggcgacagagcaagactcttaaaaaaaataataagaattgacttgtcagttcctacataaaatctgctgaagttttcataggggtcaaaacataccaatttgcagctaattgatgtctttataatattgagtttttcaattagcatggcatatccctccatttattttggtcctccttaatttctctcaataatgtctgatagtttcctgtataggactcttgcacatgttttgttagatttgtttttaggtatttgatgctatcataaaaagtatcttttttttctcaaattttaatactgattgatttttgtgtattgaacttgtatccagtgaactttcctaatacacttactatttttaacagatgtgtatagattattttaatcttttcaatacataacagtgtcataagcaaataataaatctcttattttttcacttctaatccttttaccttttatttatttttttttactctatttcactggttaggactttcattacagtgttgaatgtaagtgacaacaacaggtgttcttgttttattgccactctaaggaggaaaacttttagtatttcaccactaaatatgacgtttgctataaggttttgtttcatatgctaaggacgtgttcttctattcctggtttgctagaaatgtttttcttattacaaactggtatagaattttaaacttcatcctaactcatttattgagactatcatagactttttctaatttatacctcttttctcacttttccttgatgtttatccattcaaataattgatgataaattgatttttcttgacaaaagttaattttttattattataatgaatgcaatatttattaagctcatattaaggttttttgtttgtgtgttttttgtagagatagggtttcaccacgttggccaggttggcgttgaactcctggccactagtactcagcccgccttggcctaccaaaatgctgggattacaggcatgagccaccacacgcagcaatattaaggtattttcttaaaaaatgttaaatgtaccataggaagagagagtactcataaaattaaaactatcagaactttgatataataaataattttgaaaaatatcatgtcacctttgaattcatagagtaaaccaaacttgatgataacaattgtttattttatcactggattcaaatttataatatataataaaatttttatttttgttcattagggagattggcctttaaattttttttttgaattcaatgatttatttttatttatttatttatttatttatttatttatttattattatactttaagttttagggtacatgtgcacaatctgcaggttagtcacatacgtatacatgtgccatgctggtgcgctgcacccactaactcatcatctagcattaggtatatctcccaatcgtatccctcccccatcccccgaccccacaacagtccccagagtgtgatgtcccccttcctgtgtccatgtgttctcattgttcaattcccacctatgagtgagaatatgcggtgtttggttttttgttcttgtgatagtttactgagaatgatgattttcaatttcatccatgtccctacaaaggacatgaactcatcactttttatggctgcatagtatcccatggtgtatatgtgccacattttcttaatccagtctatcattgttggacatttgggatggttccaagtctttgctattgtgaataatgccgcaataaacatacgtgtgcatgtgtctttatagcagcatgttttatagaccttagggtatatacccagtaatgggatggctgggtcaaatggtatttctagttctagatccctgaggaatcgccacactgacttccacaatggttgaactagtttacagtcccaccaacagtgtaaaagtgttcctattcgtccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatggctaggttttcttctagggtttttatggttttaggtctaacgtttaagtctttaatccatcttgaattaatttttgtataaggtgtaaggaagggatccagtttcagctttctacatacggccagccagttttcccagcaccatttattaaatagggaatcctttccccattgcttgtttttctcaggtttgtcaaagatcagatagttgtagatatgcagcattatttctcagggctctgttctgttccattgatctatatctctgttttggtaccagtaccatgctgttttggttactgtagccttgtagtatagtttgaagtcaggtagtgtgatgcctccggctttgttcttttggctcaggattgacttggcgatgcgggctcttttttggttccatatgaactttaaagtaattttttccaattctgtgaagaaaggcattggtagctttatggggatgacattgaatctgtaaattaccttgggcagtacggccattttcacgatattgattcttcctacccatgagcatggaatattcttctatttgtttgtatcctcttttatttccttgagcagtggtttgtagttctccttgaagaggtccttcacatcccttgtaagtttgattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatccgcttaaggagattttgggctgagacaatggggttttctagatatacaatcatgtcgtctgcaaacagggacaatttgacttcctcttttcctaattgaataccctttatttccttctcttgtctaattgccctggccagaacttccaacactgtgttgagtaggagtggtgagagagggcatccctgtcttgtgccagttttcaaagggaatgcttccagtttttgcccattcagtatgatattggctgtgggtttgtcatagatagctcttattgttttgaaatacatctcatcaatacctaatttattgagagtttttagcatgaagtgttgttgaattttgtcaaaggccttttctgcatctattgagataatcatgtggtttttgtctttggttctgtttgtatgctggattacatttattgatttgcgtatgttgaaccagccttgcatcccagggatgaagcccacttgatcatggtggataagctttttgatgtgctgctggattcgttttgccagtatcttattgaggatttttgcatcaatgttcatcaaggatattggtctaaaattctcttttttggttgtgtctctgcccggctttggaatcagaatgatgctggcctcataaaatgagttagggaggactccctctttttctattgattggaatagtttcagaaggagtggtaccagttcctccttgtacctctggtagaattaggctgtgaatccatctggtcctggactctttttggttggtaagctattgattattgccacaatttcagacctgttattggtctattcagagattcaacttcttcctggtttagtcttgggagagtggatgtattgaggaatttatccatttcttctagattttctagtttatttgtggagaggtgtttgtagtattctctgatggtagtttgtatttccgtgggatcggtggtgatatcacctttatcattttttattgcgtctatttgatttttctctctttttttctttattagtcttgctagtggtctatcagttttgttgatcttttcaaaaaaccagctcctggattcattcattttttgaagggctttttgtgtctctatttccttcaattctgctttgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtatcccagagattctggtatgttgtgtctttgttcttgttggtttcaaagaacatctttatttccgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaagaaaatgtatattctgttgatttggggtggagagttctgtagatgtctattaggtcagcttggtgcagagctgagttcaattcctgggtatcctttttgactttctgtctcattgatctgtccaatgttgacagtggggtgtcaaagtctcccattattaatgtgtaggagtctaagtctctttgtaggtcactcaggacttgctttgtgaatctgggtgctcctgtattgggtgcatatatatttaggatagttagctcttcttgttgaattgatccctttaccattatgtaatgcccttctttgtctcttttgatctttgttggtttaaagtctgttttatcagagactaggattgcaaaccctgcctttttttgtttttcatttgcttggtagatcttcctccatccttttattttgagcctatatgtgtctctgcacatgagatgggtttcctgaataccgcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaaggattttatttcttcttcacttatgaagcttcgtttggctggatatgaaattctggcttgaaaattcttttctttaagaatgttgaatattggcccccactctctcctggcttgtagagtttcggccgagagatcacctgttagtctgatgggcttccctttgagggtaacccgacctttctctctggctgtccttaacattttttccttcatttcaactttggtgtatctgacaattatgtgtcttggagttgctcttctcgaggagtatctttatggcgttctctgtatttcctgaatctgaatgttggcctgccttggtagattggggaagttctccagggtaatatcttgcagagtgttttccaacttggttcccttctccccgtcactttcaggtacacccatcagacgtagatttggtcttttcacatagtcccatatttcttggatgctttgctcatttctttttattcttttttctctaaacttcccttctcacttcatttcattcatttcatcttccatcgctgataccctttcttccagttgattgcatcggctcctgaggcttctgcattcttcacgtagttctcgagccttggttttcagctccatcagctgctttaagcacttctctgtattggttattctagttatacattcttctaaatttttttcaaagttttcaacttctttgcctttggtttgaatgtcctcccatagctcggagtaatttgatcatctgaaaccttcttctctcagctcgtcaaagtcattctccatccagctttgttctgttgctggtgaggaactgcgttcctttggaggaggagagtcgctctgctttttacagtttccagtttttctgccctgtttttcccccatctttgtggttttatctacttttggtctttgatgatggtgatgtacagatgggtttttggtgtggatgtcctttctgtttgttagttttccttctaacagacaggaccctcagctgaggtctgttggagtacccggccgtgtgaggtgtcagtctgcccctgctggggggtgcctcccagttaggctgctcaggggtcaggggtcagggacccacttgaggaggcaggctgccccttctcagatctccagctgcatgctgggagaaccactgctctcttcaaagctatcagacagggacatttaagtctgcagaggttactgctgtctttttgtttgtctgtgccctgcccccagaggtggagcctacagaggcaggcaggcctccttgagctgtggtgggctccacccatttcaagcttcccggctgctttgcttacctaagcaaacctgggcaatggcaggcgcccctcccccagcctcgctgccgccttgcagtttgatctcagattgctgtgctagcaatcagtgagactccgtggttgtaggaccctctgagccaggtgcgggatataatctcgtggtgcaccattttttaagcctgttggaaaagcgcagtattcgggtgggagtgacccgattttccaggtgccgtctgtcacccttttctttgactaggaaagggaactccctgaccccttgtgcttcccaagtgaggcaatgcctcgtcctgcttcggctcgcgcacggtgtgcgcacccactgacctgtgcccactgtctggcactccctagtgagatgaagccggtacctcagatggaaatgcagaaatcacccatcttctgcatcgctcacgctgggagctgtagaccggagctgttcctattcggccatcttggctcctccctctattta

SEQ ID NO: 12479 - DNA, 5679 bp, Homo sapiens
ttctttctttttattattattattattattattattatactttaagttctatggtacatgtgcacaacctgcaggtttcttacatatgtatccatgtgccatgttggtgtgctgcacccattaactcgtcatttacattaggtatatctcctaatgctatccctcccccctccctacaccccacaacaggccctggttgtgatgttccccttcctgtgtccaactgttctcattgttcaagtcccacctgtgagtgagaacatgcggtgtttggttttctgtccttgtgatagtttgctcagaatgatggtttccagcttcatccatgtccctgcaaaggacatgaactcatccttttttatggcgcatagtattctattgtgtatattgccacattttcttaatccagtctatcattgatggacatttgggttggttccaactctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatagttgaactagtttacagtcccaccaacagtgtaaaagtgttcctatttctccacatcctctccagtacctgttgtttactgactttttaatgatcgccattctaactagtgtgagatggtatctcattgtggttttgatttgcatttctctgatggccagtgatgatgagcattttttcatgtgtctgttggctacataaatgtcttcttttgagaaatgtctgttcatatcctttgcccctttttgatggggttgtttgaattttttcttgtaaatttgtttaagttctttgtagattctggatattagccctttgtcagataggtaggttgcaaaaattttctcccattttgtaggttgcctgttcactctgatggtagtttcctttgctgtgcagaagctctttagtttaattagatcccatttgtcaattttggcttttgttgccattgcttttggtgttttagtcatgaagtccttgcccatgcctatggcctgagtggtattgcctaggttttctttctttttttttttctttgagacagagtcttgctctgtcgcccaggctggagtgcaatggcgcaagctccactcactgcaagctccgcctcccaggttcacgccattctcctgcctcagtctcctgagtagctcagactacaggcacccgccaccacgcccggcaaattttttgtatttttagtagagatggggtttcaccatgttagccaggatggcctcgatctcctgacctcgtgatctgcccgccttggcctcccaaagttctgggattacaggcatgagccaccacgcccagccacctaggttttcttctagggtttttatggttttaggtctaacatttaagtctgtaatccatcttgaattaatttttgtttaaggtgtaaggaaaggatccagtttcagctttctacatatggctagccagttttcccagcaccatttattaaatggggaatcctttccccatttcctgtttttgtcaggtttgtcaaagatcagatggttgtagacgtgtggtatcatttctgaggactctgttctgttccattggtctatatctctgttttggtaccagtaccatgctgttttggttactgtagccttgtgatgtagtttgaagtcaggtagcctgatgcctccagctttgttcttttggcttaggattgtcttggcaatgcgggctcttttttggttccatatgaactttaaagtagttttttccaattctgtgaaaaaagtcattggtagcttgatggggatggcattgaatctataaattaccttgggcagtatggccatttttcactatactgattcttcctatccatgagcatggaatgttcttccatttgtttgtgtcctcttttatttcatcgagcggtggtttgtagttcttcctgaggaggtccttcacatcccttattaagttggattcctaggtattttattctctttgaagcaattgtgaatgggagctcattcatgatttggctctctgtctgttattggtgtacaggaatgcttgtgatttttgcacattgattttgtatcctgagactttgctgaagttgcttatcagcttaaggagattttgggctgagatgatggggttttctaaatatacaatcatgtcatctgaaaacagggacaatttgacttcttcttttcctaattgaataccctttatttcttcctcctgcctgattgccctggccagaacctccaacactatgttgaataggagtggtgagagagggcatccctgtcttgtgccagttttcaaagggaatgcttccagtttttgcccatccagtatgatattggctgtgaatttgtcataaatagctcttattattttgagatacatcccatcaatacctaatttattgagagtttttagcatgaagtgctgttgaattttgtcaaaggccttttctgcatctatcgagataatcatgtggtttttgtctttggttctgtttatatgatggattacgtttattgatttgcatatgttgaaccagccttgcatcccagggatgaagcccatttgatcatggtggataagctttttgatgtgctgctggattcggtttgccagtattgtactgaggatttttgcattgatgttcatcagggatattggtctaaaattctctttttttgttgtgtctctgccagggtttggtatcaggatgatgctggcctcataaaatgagttagggaggattccctctttttctattgactggaatagtttcagaaggaatggtaccagctcctccttgtacctctggtagaatttggctgtgaatccatccggtcctggactttttttggttggtaggctattaattattgcctcaatttcacagcctgttattggtctattcagggattcaacttcttcctggtttagtcttggtagggtgtatgtgtccaggaatttatccatttcttctagattttctagtttatttgcatagaggtgtttatagtattctctgatggtagtttgtatttctgtgggatcggtggtgatatcccctttatcattttttattgcatctatttgattcttctctcttttcttctttaatagtcttgctagtggtctatcaattttgttgatcttttcaaaaaaccagctcctggattcattgattttttgaagggatttttgtgtttctgtctccttcagttctgctctgatcttagttatttcttgccttctgctagcttttgaatgtgtttgctcttgcttctctagttcttttaattgtgatgttagggtgtcaattttagatcattcctgctttctcttgtgggcatttagtgctataaatttccctctacacactgctttaaatgtgtcccaggaattctggtatgttgtgtctttgttctcgttggtttcaaagaacatctttatttctgccttcattttgttatgtacccagtagtcattcaggagcaggctgttcagtttccatgtagttgagtggttctgagtgagtttcttaatcctgagttctagtttgattgcactgtggtctgagagacagtttgttataatttctattcttttatatttgctaaggagtgttttacttccaactatgtggtcaattttggattaagtgtgatgtggtgctgagaagaatatatattctgttgatttagggtggagagttctgtagatgtctattaggtccacttggtgcagagctgagttcaattcctggatatccttgttaactttctgtctcattgatctgtctaatgttgacagtggggtgttaaagtctcctattattattgtgtgggagtctaagcctctttgtaggtctctaaagacttgctttatgaatctgggtgctcctgtattgggtgcatatatatttaggagagttagctcttcttgttcaattgatccctttaccattatgtaatgcccttctttgtctcttttgatctttgttggtttaaagtctgctttatcagagactaggattgcaacccctgcctttttttgttttccatttgcttggtagatcttcctccatccttttattttgagcctatgtgtgtctctgcacatgagatgggtctcctgaatacagcacactgatgggtcttgactctttatccaatttgccagtctgtgtcttttaattggagcatttagcccatttacatttaaggttaacattgttatgtgtgaatttgatcctgtcattatgatgttagctggctatcttgctcgttagttgatgcagtttcttcctagcatcgacagtctttacaatttggcatgtttttgcagtggctggtaccagttattcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactcttttctggcttgtagagtttttgctgagagatccactgttagtctgatgggcttccctttgtgggtaacctgacctttctctctggctgcccttaacattttttccttcatttcaactttggtgagtctgacaattatgtgtcttggagttgctcttctcgaggagtatctttgtggtggtctctgtatttcctgaatttgaatgttggcctgccttgctaggtaggggaagttctcctggataatattctgaagagtgttttccaacttggttccattctccctgtcactttcaggtacaccaatcagacgcagatttggtcttttcacatagttccatatatcttggaggctttgttcgtttctttttactctttttttctctaaacttctcttctcacttcatttcattcatttgatcttcaatcactgataccctttcttccagttgatcgaatcagctactgaagcttgtgcatgcgtcacgtagttctcatgccatggttttcagctccactggtcatttaaggacttttctacactggttattctagttagccatttgtctaatattttttcaaggtttttagcttctttgcgatgggttcgaacatcttcctttagctcagagaagtttgatcgtctgaagccttcttctctcaactcatcaaagtcattgtccgtccagccttgttttgttgctggcaaggagctgcattcctttggaagagaagaggcactctgatttttagaattttcagcttttctgctctggtttctccccatctttgtggttttatctacttttggtctttgatgatggtgacgtacagatggggttttggtgtggatatcctttctgtttgttagttttccttctaacagtcaggaccctcagctgcaggtctgttggagtttgctggaggtccgctccaggccctgtttgcctgggtatcaccagcggaggctgcagaacagcgaatattgcagaacagcaaatgttgctgcctgat

SEQ ID NO: 12480 - DNA, 40898 bp, Homo sapiens
ttattatactttaagttctagggtacatgtgcacaatgtgcaggtttgttacacaggtatacatgtgccatgttggtttcctgcacccattaactcgtcatttacattaggtatttctcctaatgctatccctccccctgaccccaccccatgacaggcctcagggtgagatgttccccaccctgtgtctaagtgttctcattgttcaattcctacctatgaatgagaacatgtggtgtttggttttctgtccttgggatagtttgctcagaatgatggtttccagctgcatccatgtccctgcaaaggacatgaactcatccttttttatggctgcatagtattccatggtgtatatgtgccacattttcttaatccagtctatcattgatggaaatttgggttggttccaagtctttgctattgtgaatagtgccacaacaaacatacaagtgcatgtgtctttatagtagcatgatttataatcctttgggtatatacccagtaataggatggctgggtcaaatgataattctagttctagatccttgaggaattgccacactgtcttccgcaatggtggaattagtttaccaccccccccaccaacagtgtaaaagcattcctatttctccacatcctctccagcatctgttgtttcctgactttttgattatcgccattctaactagcgtgagacagtatctcattgtggttttgatttgcgtttctctgatgaccagtgatgatgagcattttttcatgtgtctgcgggtgcataaatgtcttcttttgagaagtgtctgttcatatcctttgccctctttttgatggggttgttttcttcttctaaatttgtttaagttctttgtagattctagatattagccctttatcagatgggtagattgcaaaaattttctcccattctctatatttcccattcactctgacagtagtttcttttgctgtgcagaagctctttagtttaattagatcccatttatccagtttggcttttgttgccattgcttttgatgttttagtcatgaagtccttgcccatgcctatgtcctgaaaggtattgcctaggttttcttctaggatttttatggttttaggtctaacatttaagtctttaatccatcttgaattaatttttgtataaggtgtaacgaagggatccaatttcagctttctacatatggctagctagttttcccagcaccatttattaaatagagaatcctttcccatttcttgcttttgtcaggtttgtcaaagatcagatggttgtagatgtgtggtgttatttctgaggcctctgttctgctccattggtctatatatctgttttggtaccagtgccatgctgttttggttactgtagccttgtagtagagtttgaagtcaggtagcgtgatgcctccagctttgttctttttgcttaggattgtcttggcaatgtgggctcctttttggatccatatgaactttagttgtttccaattctatgaaaaatgtcattggtagcttaatggggatggcattgaatctataaattaccttgggcaatatggccattttcaccatattgattcttcctattcatgagcatggaaggttcttccatttgtttgtgtcctcttttatttcgttgggaagtggtttgtagttctccttgaagaggtccttcacatcccttgtaagttggatttctaagtattttattctctttgtagcaattgtgaatgggagttcactgatgatttggctctctgtctgttattggtatttaggaatgcttgtgatttttgcacattgattttgtatcttgagactttgctgaaattgcttatcagcttaaggagattttgggctgagacgatggggttttctaaatataaaatcatgtcatctgcaaaaagggacaatttgacttcctcttttcctaattgaatacctttatttctttctcttgcctgattgccctggccagaacttccaacactatgttgaataggagtggtgagagagggcatccctgtcttgtgccagttttcaaagggaatgcttccagtttttgcccattcagtatgatgttggctgtgggtttgtcataaatagctcttattattttgagatacgttccatcaatacctagtttattgagagcttttagcatgaaggctgttgaattttatcaaaggccttttctgcatctattgagacaatcatgtggtttctgtcattggttctgtttatgtgatggattatatttattgatttgcatatgttgaaccagccttgcatcccagggatgaagctgacttgatcgtggtgcataagctttttgatgtgctgctggattcagattgccagtattttattgaggatttttgcatcaatgttcatcagcgatactggtctaaaattctctttttttgttgtgtcactgccagcctttggtatcaggatgatgctggcctcataaaatgagctagggaggattccctctttttctattgatcggaatactttcagaaggaatggtaccagctcctctttgtatctctggtacaattcggctgtgaatccgtgtggtcctggactttttttggttggaaggctgttaattattgcctcaatttcagagcctgttattggtctattcagagattcaacttcttcctggtttagtcttgggagggtgtatgtgtccaggaatttatccatttcttctatattttctagtttatttgcatagaggtgttcatagtattctttgtatttctgcgggatcagtggtgacatcccctttatcatttttattgcatctatttgattcttctctcttcttctttagcagtcttgctagcagtctatcaattttgttaatcttttcaaaaaatcagctcctgaattcattaattttttgaagggttttttgtgtctctatctctttcagtgctgctctgatcttagttatttcctgcattctgctagcttttgaatttgtttgctcttgcttcactggttcttctaattttgatgttagggtgtcaattttagatctttcctgctttcttgtgggcagttagtgctataaatttccctctacacactgctttaaatgtgtcccagagattctggtacattgtgtcttttttctcattggtttgaaagaacatctttatttctgccttcatttcattatttacccagtagtcattcaggagcaggttgttcagtttccatgtagttgtgcggttttgagtgaatttcttaatcctgagttctaatttggttgcagtgtggtctgagagacagtttgttgtgatttctgttcttttacatttgctgaggagtgctttacttccaactatgtggtcaagtttggaataagtgcgatgtggtgctgagaagaatgtatattctgttgatttggggtggagagttctgtagctgtctattaggtctgcttggtgcagagctgagttcaggtcctggatatccttgttaaccttctgtctcgttgatctgtctaatattgatagtggggtgttaaagtctcccattattattctgcgggagtctaagtccctttgtaggtctctaaggacttgctttatgaatctgggtgttcctgtattgggtgcatatatattaaggatagttagctcttcttgttgaattgatccctttgccattatgtaatggccttctttgtctcttttgatctttgttggtttaaagtctgttttatcagagactaggattgcaacccctgcttttttgccttccatttgcttggtagatcttcctccatccctttattttgagcctatgtgtgtctctgcacatgagatgggtctcctgaatagagcacactgatgggtcttgactccttatccaattttccagtctgtgccttttaattggggcatttagcccatttacagttaaggttagtattgttgtgtgttaatgtgatccagtcattatgatgttagctggttattttgcccattagttgatgcagtttcttcctagcattgatggcctttacaatttggcatgtttttgcagtgtctggtacaggttgttcctttccatgtttagtgcttccttcaggagatcttgtaaggcaggcctggtggtgacaaaatctctcagaatttgctgtctgtaaaggattttatttctccttcacttatgaagcttagtttggctggatatgaaattctgggttgaaaattcttttctttaagaatgttgaatattggcccccactctcttctggcttgtagagtttctgccaagaaatccactgttacactgatggtcttccctttgtgcgttacccaacttttctctctggttgcccttaacttttttcccttcatttcaaccttggagaatctgattcccttccaaaatggccaaataggaacagctccagtctgcagctcccagtgtgatcaacgcagaacacgcatgattactgcatttccaactgaggttcctggttcatcacactgggactgttggacagggggtgtagcccatggagggcaagccgaagcagggtggtgcattgtctgaaccaggaagtgcaagggttcaggggatttccctttcctaaccaagggaatccgtaccttcgccaaagactgtacctggaaaaacaggacactcctgcccaaatactgtgcttttccaatggtcttagcaaacggcacaccaggagattatatcccatgccgggttcagcaagtcccactcccatggagccttgctcactgctagtgcagcagtctgagatcaacctgcaaggcagtagcctgtcagggagaggggcatctgccattactgagccttcagtaggtaaacaaagcagcctggaagctcaaactgggcggagcctaccacagctcagcaaggctactgcctctgtagactccacctatgggggcagggcatagctgaacaaaaggcagcagaaacttctgcagacttaaacgtccctgtctgacagccctaaagagagcagtggttctcccagcatggtgtttgagctcagagaacagacagactgcctcctcaagtgggtccctgacccccgtgtagcctaactgggagagacctcccagtagtggccgactgacacctcatacaggcaggtgcccctctgggacgaagcttccagaggaaggattgggcagcaatatttgctgttctgcaatatttgctgttctgcagcctctgctggtaatacctaggcaaacagggtctggagtggaccaccagcaaactccaactgacctgcggatgactgttagaaggaaaatgaacaagcagaaaggaatagcatcaacatcaacaaaaaggacaaaaaaggacatccacaccaaaaccccatctgtatgtcaccaacatcaaagaccaaaggtagagaaaaccaaaaagatgaggagaaaccagagcagaaaagctgaaaactctgaaaaccagagtgcttcttcctcctccaaaggattgcagcccctcgccagcaacagaacaaagctggatggagaatgacttagaagagctgacagaaataggcttcagaaggtcggtaataacaaacttctctgagctaaaggaggatgttcgaatccatcacaagaaagctaaaaaccttggaaaaagattagatgaatggctaactcgaataaacagtgtagagaagaccttaaatgacctgatggagctgaaaaccatggcacgagaactacatgactcatgcacaagcttcaatagccgatccaatcaagcagaagaaaaggtatcagtgattgaagatcaatttaatgaaataaagcgagaagagaagtttagagaaaaaaagagtaaaaagaaatgaacaaagcctccaagaaatatgggactatgtgaaaagaccaaatctatgtgtgattggtgtacctgaaagtgacggggagaggggaaccaagttggaaaacactcttcaggatattatccaggagaacttccccaacctagaaaggcaggccaacattcaaattcaggaaatacagagaacaccacaaagatactcctcgagaagagcaatcccaagacacatacagtaactattttttttagtatgactttcactcaacagtatcattaagaatcatgtgttgcatgtagctggggtctgttcattttcattctaataactcacctttgaattctttttgatgtgttatgtaatttgtagcactacataatttgtagatgatgtgatttacagataattgcatcatatgtaaataagaaaatatttttttttccaaaaccacttttatttcttgttctttcttgattgcactgtaaatgacctcaattatgatagtgaattgaaatggtaacagccactgtttttatctcattctcaatttcagaaagaaatgtttcagaaggtcattattagggatgagctttattgaaagttactttttgttttgtttagatttgtagatagcattcctcagagtaaggaatttctctcctgtttgctaaatatttgcaaaattaaaaaattaaatgtttgctaaatagggtgatagacccgtgatgcgtcgtgatgtcttatttaaggggaatgcgtgggcaatcttagtttcatggccgtgaggtaggaaccagatgccggatacagttcagtatagctacccccaagtgttacgggcccagagcgaggagagtagcacacttgcgtgggatattgatttcacggaggatggtgagtgagaaaccactaaatatttgctaaatattttggcatggatgaatgttgaaatttatataatgatttttctatatttattaagatgattatatcacatgatttttctcttttaatgctatgatcttacaaaatggtttctgttctttccaattctatatttttccctgttttttgccttttgttcaattgattgcatagtttttattattccatttcgtccctctatgagtttataaatcatatactctttcagaatactcacattagtgtacagttgggcaaaatcatccaacacaaagcctgttttgtattgaataccgtactgaaagtgaaaaaaaggatagttctattggtaatcaaagtataatttccactgactcagtatcactttcacaccatcgtaaagtcaaaaaatcttaagttggagactgtctgtagacacattgttcaataaatatcagaaagtgtaaaacatcatacaatgaaaagtccttttcctgctttagacctgcattcatccagtttccatccctctcaacataatgtgttactttttaaagttttcatactgatctttcccgaaatatttcatgcatatgtaagtcaatataatcattttgtattagtctgttctcacactgctaataaataaatacccgagactgggtaacttataaaggaaagaggtttaagtgactcacagttccacatagctggggaggcctcacaatcatggtggaaggcgaaggaggagcaaagtcacatcttacatagcagcaggcaagaagagagcgtgtgcaggggaactcccctttaaaaccatcagctcttgtgagacttattcactatcatgagaacagcatgggaaagacctcaccctgtgattcaattgcctcccaccaggaccctcccatgacacgtgggaatgatgagatctacaattcaagttgagatttgtgtggggacacagccaaaccatttcaaatatgttactactcttccatttttaagtaagtgatacatactttacacatgattatgcatcttcctttttaccttatatatttaaaagcatttcatagctacacatagaaaaatctttattttttcaataatgtatacgtttgtcccatattatatattatacttaaatcagtcccttacttataacattttgtgttgtttctgatcctgtgtttttataaacctacaaacataatacagatgtcattttgcacatgagagttattatctgtagaataaatttctggaagtggagtgctgagtctacaagcaggtgcatctgtcatcttgatagataatgtcacttgccctccatatgggttataccattttgcactcccatcatcaataattgagtctgcttatttttacctatcctcacccacagtgcctaatacatttagatttttgtcactttgaaactaagaacaataattctgtgtaactttttttttgtaattatgagtgacagtgatcatattttcataagtttaagagagatgtgagattgttcatctcttttgcccatttttccattggtctgttggtccttattgatcaaaaaatgatcattctctagcaagggtattagtcaattgtctgaacaaatgtttttcctagttcatgaaatgtatttgaattttttgatgggtagggtttttctgctttgtgttatttgcttgcttctggttttgtttggtatatagacaatttttctttgtatatggtagaatttttcataattcctacagtgtttgtcagtgttcttcagacaaacagaaccaataagatatatataattatataaagaaacttatttaaaaggaatcagctcatacaattaaggagtttggaaaggccaaaacctgaaggatggcctggcaggtgagagacccatggaagagtggatgttgtagttccagtatgaagattgtctactggcagaatttcctcttactcaggaagcagtcaggtttattattattattattattattattattattcaggcaagtaattggcccatctaccttatgaaggttaatctgctttacttgaagtccactaacttaaatgataatctcatccaaaaacaccctcatggaaacatcaagaataatgtttgaccaaatatctgaggactgtgacccagtcaaattgacacataaaattaactatcacacaccctttatggcttctgaatttttgtgtcatttttggaagatccacccccactccaaagttataaaaaaatcccatttttatctctagtgcattatgatttcatttttaataggtatatcttaaattctcatgaaatgtttcttgtgtgtgtaaccagactcaattgtccaaatattgtggattcaatataatcatgatcatcttcttctgatttaagatgccaaccttttcctaaagtttcatgtgcatttagatatctttccaagttttatgttctgtttggattattagccttattatgaaacagaaccagactgctttaattattgaatatttatagaatattttaatttctgataaagttagtctttgctctcttatttggtttctttactattctagtatataagaataaaaaaacaactaattttattacactaaaatgccatgtgccatactggtgtttctattagattcaaattaaaattacaaattagtgaagattgacatcttttttaaatcttcatttctaaaaatgtagtatgtcttttcatttgttgaagtattcttttgcttttcacttttttttttttttttttttttagaaataaggcctcgctctgtctcccaggctggattgcaatggtgcaatcatagcgcctcaaactcctgggctcaaagtgatcctcctacctttgcctcccaagtaactaggattatagacatgcatcaccacactcagttgattttttaaatttttttgtagagaagaggtttctcttcccaggcaggtctcaaacacctggcctcacgcaattctcccaccttggtctcccaaagtgttgggttccaggcatgagctactgtgccaggcttcttttgtattctttagagctatttcagaagcttctttcttcttgatataagtctgtaaattttcttggtacatttttgcatagttattttattatttttgttgctgtcataagtgtgggtctggtgtgaaggttattgaattctgtatgttagtttataacctgatacatttctgcattttcatactgcttgcagtatgaaatataagataacagtcttataatttcttctcttttccaattttcatatctgtaagttttttctttctttcttttttttttttttttttttttttttgaggcagagttttgctcttgttgcctaagctggagtgcaataacgtgatctcagctcactgcagcaacttccgcctcccgggttcaagttattctcctgccttagcctcctgagtagctgggattacaggcatgcaccaccatgcccggctaattttttgtatttttagtagaaacggggtttcaccatgttagccaggctggttttgaactgctgacctcaggtgatctgcctgcctcagcctcccaaactgctgggattacaagcgtgagccaccgtgcccaggctttctcttaaaatttcatgagattctaagtctagtacgttattaaataataaagttaatacttaatatccttttcttatgaggatacttctagtatttctccattaattttaacactagctttgggatagaagtagatacattatcccatagttaagctactattcattgatgattattttcttgagtgtttataaagaatggatttggatcattcaaatgattttttgtatctatggagattattatattactttcccttactgaaataaaagttatatctatatatttcttgatattgaacaccacctttccatatctggagtaaactgcacttggtgagagtgatatttttaattcagcagggtgagaatgtttagtgaagcattatacgttcaaaaatttgaaataatctacaggttcattaacagataaattggagttactttaataggtggatatatgtaagtgggattaatattgtatgtgaatggagattaacagattataaacatatgtagcaaggtagataaatcttataactttgcatcctctgacccctcccaaaagaaaagcagacacaaaagaatatgtactgtgtgatatgatttgcataaagtttaaacatgagaaaatttaaatgatagtgtttaggaatgcgtattttaaggaaataattatcataaaagtcaaaatattagttacctttaaaaaacagagtgggactgggcacggtggatggctcacgcctataatcccagcactttgggaggctgagatgggcagattgcttgagctcaggagttccagaccagcctgggcaacatggtgaaaccccatctctactaaaaatacaaaacttagccgggcttggtggcacatgtctgtaatcccagctacttgggaggctgaggcacaagaatagcttgaaacccggaggtggagactgcagtgagttgagattgcaccacagcattccagcctgggcgacaaagcgagatccatctcaaaaaaataaaaaattaaaataaaaaaattaaagaagaaagacagagacagagacagaaagtgattgggcaaatgagggacttccagggtgctgatatgtttaaattcttgacctgggtagtatttgcaaaagtatgtgctttataataattcatggagttttacatttatatttaatgtatttttctccatatgtgcatattgcattatgaaaagaatttaaaaattatttgcttataatttatttaaaattttcacatcactattcaggagtgaagatgtctatagttttctcctgtttttattctttttttgaggtttgatatgttgattatataaaaagaacttgaagatttccattatttgtcttggctcagaaaatgttaaaaaatcactgtataattacccattctttaaagatttaataaaagttccctgtgccttcatctgagcttgttgtttttcttgttcattgaagagatagagattgtaaaatttggcccatttaggtttttgcaatactatgggtcacatttgataaattatgttttcttagaaaattgtctattttatctaggttttgtatatttgcatcaaaataaataaagtaatgctgtacgatcttttaatttcctctatttttatagtcccccctgagcccccatatcatttactggttgtgaatttgtaccttctcctgttcctccttgattaatgaaactaacagttttgggatttttttttaagaaccaacattagcctttctttataaatttatctgatgattcgtctaattcaatccttctcaaactttgatctctatacaaatcacctggagaccttgttaaaatactgattctgatttagtaggtctgagttggggcctgagattctgcatttgtagcatgttgccagtgatcccaacattgctggcccctactttgagtaataaggttctagcacatctatttattcttttatatgtttctatctatattaatctctttcttcacttatttttctaatttcctgaaagatatttaatacatttctttccactttatttttcattactaataagttttttatttatagttgacataataattgtatatatttatagagtgcagtgttatgttttaatgattgtataccttgtataatgatcaaatcaggttaattaccgtatttgttactttaaacatttatctctctttgtggaaatatcatacaaaatcttctctttttgctgtcttgaaatgtacacaacattgttatttattacagttgcctagctgtgttataggacaccagaactattcttcttgtctaactataactttgtacccactgaccaacctctccccgtcgtgctatcccctacacctaccttccccagcctctgataacctctactctctatttctatgaggtcaacttttttagagtacacaaatgagtgagatcatgcagtgtttgtccttctgtgcctggcttacttcacttaacataatgtcctctaggtttatgctgccacaaatgatagaatttcgttctgttttatgactaagtagcattccattgtaaactattccattctatacaccacattttctttatccattcatctatggataggcatttagattgattctatatctttgctattgtgaatagcactgcaataaaaacaggagggtagctatctctttgacacaaatgatttcatttcctttggatatatataataatggcattgctgtatcatatgatagttctatttttaattgtttgagaaacttctgcatccttttccataatggctatattaatttacattattaccaacaagtcataagagttctcctttctccacattctctccagcatttgttattttttatctttttgataacagccgttctgactagggtgaggtaatagctcatagtagttttgatttgcatttccctgattattagtgatattgaccattttttgtcatatacctgttgactatttgtatgtattcttttgagaaacatctcttcaagtctgttgcccattattaatcacattgtttgttattttgttattgcattgagttccttacatattctgcatattaaccccttgttagatgcatagttcacacatactttctcctattctgtaggttgttttttcactctgatttttttcctgtgctgtacagaagctctttagtttgatgtaatcccatttgtctatttttgcttttgttgtctgtgctgtagaaatactcgacaaaatactaagaaaccaatctcatcaacacattaaaaagatgattcaccatgatcaactgattcatcccagggatgcaaggatggttcaatatatggaagttagtaaatgtgatacatcacattaacataaccaagaataaaaactctatgatcattttaatagatgctgaaaaagcattcaataaaattcaacgtcctttaacgacaaaaactcttaacaaattgcatatcaaaggaacatgcttgaacacagtaaaggccacataggacaaattcatagctaacatcatactgaacagggaaaaattgaaatcttttcctctaagacttgaaacaagacaagaatgcccacttttaccacttacattaaacacagtactggaagttctaggcagagccattaggcaagagagagaaataatggacatccaaatctgaaaggaggaagccaaattgtccctggttgcagatgacatggtcatatttatagaaaactccaaagattgcaccaaaaaactgttagaactaataaataaatttagtaaatttacagaatacaaatcaacatataaaaattagtagtatttctataaaccaatagcaaactctctgaaaaagaaatcaagaaagcaatttcatttgcaatagctaaagaaaaaaacctaggaataaacttaactgaggaggtgaaagatccctatagtaaaaactataaaacatggatgaaagaaattgaataagacacaaaaaaaatggaaaggtaacatgtgattatggattggaagaattaatatttttaaaatgttcgtattacctaaagctagctgcagattcaatgcaatccctacgaaaataccaaagacattctttacagaaatggaaaaaaaaatcttaaattcatattgaaatgcagaagactctgaatactcaaagcaatctggagcaaaaaaataaataaataaagcaacaggtatcacactacctgattttaaaatacactacaaggctatagtaatcaaaacagcatggtactggcataaaaacagacatatagaataatgaaacagaatagagaacccagaaataaatctatgcatttacaaccaattgattttcacaaagatgccaataacatacattgggggaaagagcagcctcttcaataaatggtgctgggaaaagtgattatattcagaagaatgaaactagactcctacctctcacgatatgcaaaaatcaactcaaattaagactgtaatgtaagactgggcatggtagctcatgcctgtaattccagcattttgggaggccaaggcgggcagatcacctgagatcaagaattcgagaccagcctggccaacatggcaaaaccccgtctctactgaaaatacaaaaattatctgggtgtggtggcaggtgcctgtaatcccagctacttgggaggctgaggcatgataatcagaggcatgataatcacttgaatctgggaaactgaggttgcagtaagccaagcttaccccattgcactccagcctgggggatagagtgagactctgtctccaaaaaaagactgtaatgtaagacccaaaactatgaaactactagaagaaaacataagggatatgcttcacaaaattggactgagcaaggatctttttaataagacctaagaaggacagacagcataactattttatttattaataatttattaattaagattaattttaaaaattaacatgaaattaatgatttattaatatacatgtttctatgaatttccataagtcctgctttaatagtatgtagtaggttttgacctacatactgtggtatttttatgatttctttctctagatattttgatatttcaatatttgtaccctgtctgagctaagagttgtcataacagaaaactttttaacatttaggtgctattgaccattgttttctgaattttgttaatttctcattttttgcattgatgatactgtttctacttcttaaaatttgttgaagttttctttgaggcctagtgggtggttaatttctatgactgttacacataaaggtgtatacttcattatcaaggtatattttgaggcatatcaattagactatatctatgtcatttagcactatatattttgctacttagtacttctacaccttgactaatttttcctactggatgtgtcaaaaacagaaagaagaaaattaaagcctctttaaatgggggaaagaataggtttttcaacaaatgctacctggacaactgcatatccatatgaaaagaagggaatggaaccacctttccactccatacacaaaaattaactcataatgaatcaaagagctaaatgtaagaaatagcactatgaaattctcaaaagaaaatgtaggtataaatctttatgaccttgattaggtatggattcttagatgtgataccaaaaacacaagcaacataagaaaaaatagagaaagtggaaataatcaaaattaaaaacgtttttccttcaaaggataccatcaagaaaataaaaaaataacccaaggatttggagaaaattttaacaagtcatatatgtgataagggacttgtatttaaaataatatgtaatgaaaaaggggggcacattccaagatggccaaataggaacagcttcggtctgcatctcccagcgtgatcaacacagaagacaggtgatttctgcatttccaactgaggtacctggttcatctcactaggactgcttggacagagggtgcagcccagagagggcgagctgaagcagagcgggcatcgcctcaccagggaagcatgaggggtcgggggatttccctttcctagccaagggaagccgtgacagactacctggaaaaatggggcactcccacccaaatactgtgcttttcccaaggtcttagcaactggcagacaaggtgattctctcctgtgcctggctcgatgggtcccacacccatagagccttgctcactgctagcacagcagtctgagatcaatctgcaaggctgcagcgtggctgggggaggggcatccaacattgctgaggcttaagtaggtaaacaaagcagcctggaagctcaaactgggtggggcccaccacagcttgacaagacctactgcctctagactccacctctgtgggcagggcatagctgaataaaaggcagtagacaacttctgcagacttaaatgtccctgtctgacagctctgaagagagcagttgttctcccagcattgcatttgagctcgagaatggacagactgcctcctcaagtgggtccctgacccccttgtagcctaactgggagacacctcccagtaggggccaacagacacctcatataggtggctgcccttctgggacaaagcttccagaggaaggatcaggcagcaatatttgctgttctgcaatatttgctattctgcagcctacattggagatacccaggcaaacagggtctggagtggaactccagcaaactccaacagacctgcagctgagagacctgaccgttagaaggaaaactaatgagcagaaaggaatagcatcaacatcaacaaaaaggacatccacaccaaaaccccatccataggtaaccaacatcaaagaacaaaggtagataaaaccacaaagatggggagaaaccagagcagaaaagctgaaaattctgaaaatcagagcacctcttctcctccaaaggatcacagctcctcgccagcaatggaacaaagctggatggagaatgactttgatgagttgacagaagtagtcttcagaaggtcggtaataacaaacttctctgagctaaaggagtatgttcaaacccatcgcaaggaagctaaaaaccctgaaaaaagattagatgaatggctaactagaataaacagtaaagagaagaccttaaatgacctgatggagctgaaaaccatggcatgagaacttcgtgaagcatgcacaagcttcaatagctgaatcaatcaagtggaagaaagggtatcagtaactgaagatcaaattaatgaaataaagcaagaagacaaggttagagcaaaaagagtaaaaagaaatgaatgaaacctccaagaaatatgggactatgtgaaaagaccaaatctacatctgattggtgtacctgaaagtgatgggcggatgaagccaagttggaaaacactcttcaggatattatccaggagaacttccctaacctagcaaggcaggccaacattcaaattcgggaaatacagagaacaccacaaagatattccttaagaagagcaaccccaagacacataattgtcagattcaacaaggttgaaatgaaggaaaaagtataagggcagccagaaagaaaggtcgggttacccacaaagggaagcccatcagactaacagcagatctctcagcggaaagcctaaaagccagaagagagtgggggccaatattcaacattcttaaagagaagaaatttcaacccagatttcatatccagccaaacaaagcttcatacgtgaaggagaaataaaatcctttacaggcaagcaaatgctgagagattttgtcaccaccaggcctgctttacaagagctcctgaaggaggcactaaacatggaaaggaacaaccagtaccagccactgcaaaaatatgccaaattgtaaagaccatcgatgctaggaagaaactgcatcaattaacaggcaaaataaccagcaaacatcataatgacaggatcaaattcacacataacaataataactttaaatgtaaatgggctaaataccccaattaaaagacacagactggcaaattggataaagagtcaagacccatcagtgtgctgtattcaggagacccatctcacatgcaaagactcacatagactcaaaataaagggatggaggaagatctaccaagcaaatagaaagaaaaagaaaaagcaggggttgcaatcctagtctctgataaaacagactttaaaccaacaaagatcaaaggagacaaagaacaccattacataatggtaaagggatcaattcaaccagaagagctaactatcctaaatatatacgcacccaatacaagagcacccaggttcataaaacaagtccttagagatctacaaagagacttagactcccacacaataataatgggagattttaacaccccactgtcaatattagacagatcaacaagacaagttaacaaggatatccaggacctgaactcagctctgcaccaagcagacctaatagacagctgcagaactctccaccccaaatcaacaggatatacattcttctcagcaccacgtcgcacttattccaaaattgaccacatagttggaagtaaagcactcctcagcaaatgtaaaagaacagaaatcacaacaaactgtctctcagaccacactgcaatcaaattagaactcaggattaagaaactcactcaaaaccacacaactacatggaaactgaacaacctgctcctgaatgactactgggtaaataatgaaatgaaggcagaaataaagatgttctttcaaatcaatgagaacaaagacacaacgtgtcagaatctctgggacacatttaaagcagtgtgtagagggaaatttatagcactaactgcccacaagagaaagcaggaaagatctaaaattgacaccctaacatcaaaattagaagaactacagaagcaagagcaaacaaattaaaatgctagcagaaggcaagaaataactaagatcagagcagcactgaaagagatagagacacaaaaaacccttcaaaaaattaatgaattcaggagctggttttttgaaaagattaacaaaattgatagactgctagcaagactaataaagaagaaaaaagagaagaagactcaaatagatgcaataaaaaatgacaaagtggatatcaccatcgatcccacagaaatacaaactaccatcagagaatactataaacacctctacaaaaataaactggaaagtctagaagaaatggataaattcctggacacacacaccctcccaagactaaactaggaagaagttgaatctctgaatagaccaataacaggctctgaaattgaggcaataattaatagcctaccaaagaaaaaaattccaggaccagaaggattcacagccaaattctattagaggtacaaagaggagctgttaccattccttctgaaagtattctaatcaatagaaaaagagggaatcctccctaactcattttatgaggccaacatcatcctgataccaaaggctggcagagacacaacagaaaaagagaattttagatgaatattcccaatgaacatcaatgcaaatatcctcaataaaatactggcaaaccaaatacaacagcacatcaaaaagcttatgcactacgatcaagtcagcttcatccctagcatgcaaggctgtttcaacatacacaaatcaataaatgtaatccatcacataaacagaaccaatgacagaaaccacatgattatctcaacagatgcagaaaaggccttcggcaaaattcaacagctttcttgctaaaaacacgcaataaactaggtattgatggaacgtatctcaaaataataagaactatttatgacaaacccacacccaatatcatagtgaatgagcaaaaactggaagcattcgctttgaaaaccagcacaagaaaacgatgccctctcacaccactcctgtgcaacatattgttggaagttatggccaaggcaatcaggcaagagaaagaaagaaagggtattcaattaggaaaagaggaagtcaaattgtccctttttgaagatgacatgattgtatatttagaaaaccccatcatgtcagcccaaatctccttaagctgataagcaacttcagcaaaatctcaggatacaaaatcaagtgcaaaaattacaagcattcctatacactaacagacaaacagagagccaaatcatgagtgaactcccattcacaattgctacaaagagaataaaatacctagaaatccaacttacaagggatgtgaaggacctcctcaaggagaactacaaaccactgtacaacgaaagaaaagaggacacaaacaaatggaagaatattccatgctcatggataggaagaatcaatatcatgaaaatggccacactgcccagggtaatttatagattcaaggccatccccttaagctaccaatgaccttctttgcagaattggaaaactactttaaagttcatatgaagcaaaaaagagcccgcattgccaagtaaatcctaagcaaaaagaacaaagctggaggcatcatgctacctgacttcaaactatactacaaggctacagtaaccaaaacagcatgatactggtaccaaaacagatatatagaccaatggaacagaacagaggcctcagaaataacaccacacatctacaatcatctgatctttgacaaacctgacaaaaacaagaaatggggaaagaattccctatttaataaatggtgttgggaaaactggctagccatatgtagaaagctgaaattggatcccttccttataccttatacaaaaattaattcaagatggattaaagacttaaatgttagacctaaaaccataaaaaccctagaagaaaacctaggcgatacctttcaggacataggcatgggcaaggacttcatgactaaaacaccaaaagtgatggtaacaaaagccaaaagccaaaatagacaaatgggatctaattaaactaaagagcttccgcacagcaaaagaaactatcatcagagtgagcagacaacctaaagagtgggagaaaatttttgcaatctacacatttgacaaagggctaatttccagaatctacaaagaacttaaacaaatttacaagaagaaaacaaacaaccccatcaaaaagtgtgcaaagatatgaacagacacttctcaaaagaagacatctatgcagccaacagacacatgaaaaaatgctcatcatcactggttattagagaaatgcaaatcaaaaccaccatgagataccatctcaccccagttagaatggcaatcattaaaaagtcaggaaacaatagatgctagaggatgtggagaaataggaacacttttacactgttggtgggagtgtaaattagttcaaccattgtggaagacagtgtggtgattcctcaaggatctagaactagaattaccatttgacccagcaatcccattactgggtatatacccaaaggattataaatcatgctactataaagacacatgcacacgtatgtttattgtggcactattcacaatatcaatgacttggaaccaatccaaatgtccatcagtgatagactagattaagaaaatgtggcacatatacaccatggaatactctgcagccataaaaaaataaaggatgagttcatgtcctttgtagggacatggatgtgactggaaaccatcattctgagcaaactatcccaaggacagaaatccaaacaccacatgttctcactcataggtgggaattgaacaatgagatcagttggacacagggcaagggaacatcacacactggggcctgttgtggagtgggggactgggggagggatagcattaggagaaatatctaatgtaaatgatgagttgatgggtgcagcaaaccaacatggcatgtgtatacctatgtatcaaacctgcaccttgtgcacatgtaccctagaacttaaagtataataataaaagcaaataaacaaataaacaaaatcaataataagaaaatttttaaaaagtagctattacaattcaataatacaaagacaaataactcaattttaaaatgagcaaaggatttcaaccaacatttctccaaagaagatataaaatgttagccaaacacacgagaagattttcagcgtcattcatcattagggaaatgcaaatccaaatcacagtgagatatcatttgacaccagttaggttggctatattcaaaaagacaaaaaataacaagtgttggcaaggatgtgggaaaattggaaccctcatacgttgctggtcagaatgcaaaatgttgcaacctctttgaaaagcagcctggctgtttctcaaacgattaagaatagagttaccatgtggtccaacaattctaccacttgatatctacccaagagaaatgaaaacatgtccacacaaaagcttttgtatgaatgttcatagcagcaccagacacaacagcccaacagtggaaaaaacccaaatgtccataaattgatgaatagattaataaaatgtagtaacccatataatggaatattcatcagcaataaaaataaatgaagtacttgatgcttttgcctcacaactcttaagattctttcctttgtcctgactttagataatctgatgactatgtgcctaggtgatgatctttttgcgaagaacttcccagtgttcttagagcttgttgtatgtggacgtctagatctctagtaaagccaaggaagttttcttcgattagtccctcaaatatgttttccaaacttttagatttctcttcttccttagaaacaccaattattcttaggtttggatgtttaatatagtcccaaacttcttggaagcctttttcattaaaaaaatttttttttctttgtctttgacagattgggttaatttgaaagctttgtcatcaagctctgagattctttcttctgcttctttgattctattgctgagactttcctgtgcattttgcatttctttaagtgtgcccttgatttccagaagttgtgactggtttttatttatgctatctacttcactgaaaatttttcctttcatatcctgtatcacgtttttgattctgtcactatcttctgtgtccttgccaatattttaattaaattattcactctatggtcagttatcttcactttgttttctctgtgaagttatatttttgtgctcttattagagcatttatatttttattatattagttatctttatagttataaattgatcttagtcctctggtgtttgtttattcttactagttataactgtgaatattattatatttcttccttttctctccttttatctctggatccagcagcatactgattttagtcaataatttcttttctggtgtttgctttgatataactgtgtttctgatttatgacttgatttgccaactttaaatgaaatcctttgacttccagctgttttaaattaaacagtaaacacattttctcatcatttcaatttctttccctcttctcctctcaatgtttcagttatgttttatctgccactctaactcacatttttctagttttagtggtactgttaaatatatagtctccctcaatcttttccccaaacttattgattgactgaattttctcttttattggttcccacaaaaagacatcaacaaaataatattgctccagtttttgaactcttattaaaactattgtttgtagcccttatacttcaagaagagtttgcatatatattcttatctcaaagtctctttgcttgagaatctcatgggattgtatctggtattcagagttgctgtgtaaaaacaggaaggcagcctgaattcttctttcttgtaaaattgacctagtcttttcacctgtctgccgaaaggattctttatctttgaagcccagcaactttattgggatatgtctcattggtcattctgggtctttctttatttcttctattctatcacaccaactttgccattctcaacctctgtgaatctcctgtgatttttatactatctgattcttttgccccattttgtttttatttccttaattcttctattttttttttcttggactacacctttccttagttgtgcaagctcatatcttatctcttcctgctatgctaccatactttccctgaattattccattactgtgttatatatcatctttcatccaggtgatcactttaatttgaaggattttttttcctccaaattcatggcaagacatttgttcataactttcattggtatggtaatattttacagaaggatatactttattaatacattttttgccttttttcccttttgtcttggagtatagatataatttttattattcatctttgaatggttttcattttcctaagctctgtatttataagggctttcttgaggcaggaccaggtcagctttcctgtctagcatgcttgcccagtgcaaaggttcttcttttccacagtctccacaaaggtagaacgcttctcaaaaaaatgtgccttgtctttccaaatctttatttggccttgcttcttcttttttatgaaattcattatagtcccattagggtagaaggtcacatcctgcttctgccacacctttgccagcaaggggtacagcttctgactctcaagacatacccatcacttgcgggaaggaaattgttagtagtgtgttctgagatctgtcatggctggtctcctacaactgaggtcttgagatctgtctttagcctttcccaaattcttcccagaagaattcagttgcttttagaaaatcttaaaagtattttaagatttaggataaatacttaaaagtatttaaactctctcctgaagtttatttaacaactgagtttttgttctgagttttccattctttatttgccttagggtggttccagggagagaagtttggagaaggctgcatgacgcagccatgagtatacactgggagtttccactccatccccaatctccaccaaaaagacggtgcttctgaaggtatttttttccttctaatgccttagtttctttatacagtggccaaaaatagtacaagaatatcttcatggcaactacaggcattgctcattgtatggcaagctgatttatggaacttttccactacagaattgatggttctgagcatgaactcaaacagcagttacctgaaaatccagacacatgaggtcttatcccccaatctgtcagttctgtcagggtgaaatgtgcgccttctcagccttctgtcttctttggtgctcattgctaaatagttcagtagaaatgcctcagaggaatcatcttggtgctggctccaaggctctgtgcagtcagccaggctatgaaagaaggcagcctgtgccttctccagactcattcctgctccatcctcaacctaatcttcctgaatacactctccattcaagagccgatggaaaaatggatcactgacaaataacgaattattgtatgaattaacctcttgctggcaactgggcagtttgatagcagactcaaactgggtgatttgagaatttaataaagggactactaattcatcctatgctaatatgaaccctcatttagggttgagagagagtagccaagggatagtgcagtagttggggatttattaatggcagagagcctttaccatttcttgacctggaggggctaaatggcacaggaaacacccaagagtattgcatagctagggcttctggaaaggagcttcagccttcagtagtgggctataggctgtagaaggagggaagtagggaaaagaatctcaccctctctgtgtcaccttctcagctcctgccagtgcttctcattggccaaaccaaatcaacagccagatagcaaatggagttacttgattaagtcctcctatgatggggggaagacagtggatatggaggggcagaaagaaaataaacaaccctacagggatccaccaattgcttttattcagaataaaattttattcagaataaaatttcaaagctattttattctgtaccaaacattgcaaatgttggcttgcggaaagcaaatacaagattattctaaagaaaacattaagcctgaggccatatatcaattacaaggtgaattttagggctcaacacagttatatatcatcaagttcaaatgaacaaatgcctggatttgaatgctaaggcataggattatttcaatatgcacactctgagcattttctgaaaatcatcaagcttttattaccattttatcctaaatcccctgaccacttctcattcaatttgcatgaacaggcctcctctttccacccttattttaatcctggagtttcctaactcagccttctcctctgctaattctactccttctcatagacaggtaactttttctattctttgacatcagtttccacatcttctctagtgagatttcatactatttctttagctcagccctcccttatgaattctcagcccacagaacatagctgccaactggacattttcacctggatgctttatagacatcttaaatcatgttgaaaaactaactcattatcttaagcattcccaaacaaccttctaactcacgcgtgtgcgcacacacacacacacacacacacacagacaccctgcctattcctgaattctcaaacttttaaaatatttcatggccttcatttttgttttctaacaaaaatagataaatgtatgaatggaatgtttttttggcagagaaataagtaaatatttttaaaatttcttcagtgttttctacaatgaaaaggaaatcaacaatttctatactctacgtaggggtcagcttcccaaacccatgacccattagtaatcatcaacaccttatccctggtctcccatatcccggtggttataaattcatggttaaggcacatagctcatgtcttccctgcttggaactgtatgcccatgtctggcattaaaacagctatttcttgaatgagtaactctatgtcttttagctctatgctctaactatctccactgccagccctgcttcatctgattttagtcaataatttcttttctggtgtttgctttgaggacctatgtcaagatctgctgccaccaccttcacataggttctcagtgtcttcctcctatagcaccaaagggccttccagaggccttcctgcctccaaatattccctctctaatcctttctcttcactgcagccaattacctttctaaagggcaattgtggtccctctttaatttaattttattttatttgagaccggttctggctctgtcacccagtttggagttcgatggtgcaatctcagctcactgcaacctctgcctcccaggctcaagctgtcctgccacctcagcctcccaggtaactgggactataggtgcatgccaccatgcccagctaatttttctatttctttgtagagatgaattttcaccatgttgccaggctggtctcaaactcctgagctcaagttatctgcccacctcggccttccaaagtgctggtattacaggcatgagccactgagcccataaataataataagaaaactcactacttctgccttgctggctgggccacagacgattcctgtgtatttcccaaaacagtatgcacacacttgcatttgcaggttagagacaaagtatgtccactctaggttcttgctgcccttgagctaccttccagtttgctacctcctatctacaggactaagacccaagttcttagcatggaaatcagttttccttttcagcctcatttcctgccttacccatccactcacttagaacttggattcttcaacctcttacagtcccctaaaatgttttctgtgtgccatgccccttttgccttccccaggagttcctatttatgcttcaagaagcatctcaaatatcactccctccatgatgcctttgcgaactctctagcattagctgctccttcctctgatgttgtcctattttgtctatctctgtgttgtgcaataattacatctttacatttctgttggcccagcacaagccctacaggccagggctgtattgtagttttctttgtcatcctacccatcagtgccaaatttggaaaatagcaagaactcaatcaatagatgctaaactaatgaacactttattagcctacatttatggagcattcttggtacccattaaacagtttcatctctctcatatgtcagtgttatgtttcactgcagctttccctaaggaattttgtgagaaatatggagtattgcagcactattctttggtcacatgggggtttaattcctatttatacttttcttgtattactagaaataatgactgtaactacttatctggcaaatctctgaaatttctttttaaggaaattgttattgttggagaaatttgcaaagcccgactctgccagggctctattcctcatatctaagcagttaattctctactacgttacgtttagctttcggctctggaaacactctttgaatgcctcctttgtgcagatttatccaactctctcctctttctttcattaagcttgccctgtaaagccatattccttctgttttcaattgtgaatttatttcctctggagctttctgacttagaatctatttgaacttctatagaaactttggttgaaaaggaaaaaaagaaaaaaaagggcctatttttaaaggttttctctttcacctaatattagaggggatttctttgtgattaaacaaatttgttataaagtaacacacactgtgaaatatccaaacaactacaatgtcattataaatatatttttcttatcagagaaggcaacaggcaaatcagccactcttgcaaggtcatatttcacagagacagctgaattcacccactgttgaattatgttataaagccagtgatttagtattgtcatctattttgattgacaccaaaagccttccaggacagtaaatgtaaagatgttagaagaaaatcacttacaaaatggcttgatagttcatgttaatgagttttaaaatgcggtataacaacttaatcaaatcagacagctccataaaagaattaatttggtcattggctctctttccaaaatgactttgttgtactgagtaaggtgagaatttttctgtggctgaaacattcacaactagattcgaaatgacatagcctgggataagttatggattaaccaaagtttctcaggagttatttatatttggcctcttgttaaatgagatgcatgtcttttctgaagtttcattttaatgaaagagaaagaagaatatgaatgacatgtattaaagaccccgagcccacacttaaaacctcaattttggataacttgtgtgttaccttttagaaattagagtgtcattgggttgctattatgggtcgccaacagaaggggattcaggaatatctccatactgccccagaccacagcaataattttctgcaatgtcaagagaaaaacacaggacaataaccagttgaaagcagcaaagttctgcattattttttgctgtcctcttgtcccaaactctagaggagattattagaaacgtagtatctgcccctgtagaattatgggcttatgacaagactagagacctaaggagactagtttcttgtctatccgggctcaaacaccaacctctttcatgcacttccagactgaagttgtttctaaggtcagctttaaggagaaaattacatataatcagaattaccctccagaattcataaatcaccttccattggtatagatcactgtctcttggattgagcagcagattaagtagtcagattgcatttaggtttacattatataaaatttaatatgttttggctgggcgcagtggctcacacctgtaatcccagcactttaggaagccaaggtgggaggatggatagaggtcaggagttcaagaccagcttgggcaacatagcaagacctcatctctataaaaactttaagaattagctggacacagtggcacatgcctgtagtcccagatacttgggaggctggggcagaaggatcatttgagcccaggagtttgaggctgcagtgagctatgatcatgacactgcactccagtctgggtgacagaatgagaccgtgtctctttaaatattaggaatcaccttcagaatggcattgaaaggcaggaagtctgccaggcagtgcgtgagggaagagcagagtcatagactctcctcagactatcttattgacggacaagttacaggtacttttaaaatcagtctctccttcctctctctctctccttttctcagctttctgtctctctcctagagttaaattttaatgaaaaaaaataatgtgaattatttgtgtgttatatatgtgtaacatttctatgtatttatattattaatatgacataataatataatatttgtattattaatatttatttaaaaccatcagcacacacttagaacctccgttttgggtaatgtagttattaccaacattcctacctgacatttatttgtgtatttgttcagtgtatatctgtgtcttctgtgagactgtggggtttatgaagaaagggactatgtatcttttggctcaccatttcattcccacgactagcatggagccgaagaggagatgaaaacatttttatcaaatgaatggctaaaggagagagaccattagacattactacctttggaagttctcttagtaactgtggctcaatcatgttgcagtgttatagacacctttataatttacaaagaactttcacaaacatggcctcattataaaggtgacaagcatgattgtcccccataccagtctgtagaagaagaaactgagacttggagaggctaaccaacttgtgcaaagttgcacagctaacttatgacagaactaggtcttgaacccctgtcttctaacccttagccagaccagttggagttccccatccccagtgacctctcctacatttatggggactcttgtgtatcagagtttgtgactctgtgcccgtgtaaggcagtgatcacatcttgtccctcacaacagagatgtattaagtgcctactatgcgccagacatgcaaaaaacttccaggacgcaaacaagaatgagatgtatgtatttcttgccatcaaaacaactcacaatctaatgcagcatagtgttaaacatgtacatttctaatatactgttgaatatgtttgtggatgaaatcctatcctgcttgcagttgcaataatctgcaggttaaatggaaggaaaagcaaggcttgctggtttgcacaaacgttaacaactattagctcaagttcgaaacaagattgtaaccattctgcacaagtgttaaggagtgcatatttgcagagctgaggccaggaggcttaaattttagaaacagctgtggaactcctttcagtatgtacagttggaaggaggctggcattgtcagggagtcgctctggaaaatacaggcactgaatatattttatcttttcccttattccagtgttagtgtccccatagaattccaagtgagaaaataacctgcaaaggtgtgaggtgggaatcatattacaacattcaagcaggtgagatcctcagagatgaaaggggaagaaaatggcactttaatgcatgagagtaatcttccaggatttgtaccaggatgtgttatattttaacaagaagagttctcagaagggtcagtttcaggaacatcacatgaacccctggagaaaagtaaatggttgattggctgtcacacttactgtttcaatatgctgggtaaagcaaagcgaggaaaggtgaggtctcaccaagtgcagattacaaaacaaatgcattctttgtgtgcttttttcatagtagatgattttgaaacaaaaagagaaaaataaacctgttgagtagaaacttgggaagtaaaactgagtgatagaggattagttttcacatgtaggcggtacacagagtttgtacagtttcgtagttacaagacagggtagaatgaatatttaaagagaagactgttaggaacaatggttcagaaggatgaaggaactcaataaggttgtgagggattgagaaggaatgttttgcttgaaacatggagtatggcaacaatgaatgagcctagttttgaatcaaaatgacctgaaaaacttctgtagaaagtttccaacaaagcagtgctgtattatggaagatcctgccatatggattgaaacttttctagaacttttaatagacgagccctcataagtaagatccaggcaaccaaattactactctttgaatgctattgtgggtatcatgtcaagatccaatgttttctttccatgttatactaaagaaataaaacttaatgtctatagttcaggttatatttgaaactttaatagttctagattgaagctagcataaaaacactgtatactgagcatggtggctcacacctgtaatctcaatgctttgagaggccaaggccagaggatcacttgaggccaggagttcaagaccaacctgagcaacatagcgagaccccatctgatatggtttggctctgtgttcccacccaaatctcacctcaaattgtaataattcccatgtgttaagagcgagaccaggtggagataattgaatcatggtggcagtttcctctatgctgttctcatgatagtgacttctcatgagatctgatggttttataaggggcttcccccttttctcagcactcatcctccctcctgctgccctgcgaagaggtgctttctgccatgattgtcagtttcctgaggccttcacagctatgcggaactacgagtcaattaaacctcttttctttataaattacccagtcttgggtatttcttcatagcagcatgaaaacagactaatacagtaaattggtaccaggagtagtggatcactgctgaaaacatacccaaaaaatgaaaataaaaaattagccagacatgatggcatgctcctgaggtctagctattcaggaggctaaggcaggaggatcgcttgagcccagaagtttgaggttacagtgagctatgattgtgccactgcactgtagcctgggtgacagggtgagactttgtctctaaaaaagtgaaattaaaaaaaagaaagactccataaatgacattttaaagggaaaaaatgtttatgacaattatattgtatattcaaacaaaatgtattcttatttcataaccaatgaaaatctgtgttgactggaaaagagattaattatggtcactgagaagcagaatgtaaagcattatttgcaggaaaagaaagcctagtttcctttacatgccactcacatattggtattttctcattattagaacttacatttttttaagttcagagttttaaaattccccagagacttctgcaaaacctgaaccatcattgagtaatccatcaaaaatccagaggcattaaaagttccatgactaatatgtgtgaaatgtttgaagatgaaactctcttttgtaattatagaccgcagaatgtggaatagtttctgccgtttgaattacctacctgaggatactacttgaaagttccatcttccgtaaataacagccagcctgttatagaagacaggcagtgttttcatacctggaatagaaattattttagaatcatttccatgcaacattttttcattattactaagatctggtgactatgaaagggagtaaacttacacagctggctcttttcagacagagagattcaatttattcttgttccaatactgtaggaaaataaaaaggttaaaattaccttttggattcaatgtgatattttccctagatacctaaacaaatggaagacaggcagctttcccagctttggaataggggacagtaagggatttcccttgtagcgtgttgtgttttatctgaaatctggcccttttctgtaattaaaaaagggatttaggtactgaatttaatcctttaaatggccaatatcttgtaacttttccagatatttccctggttcatcaagaggcaagagacttactttaattctgatctaatatgtacctgccttttaattatgtgctaaaacaatttgggagatgggatggtttggtacaaacttgctcctgctgtggaaatggtgacttggttgatctaggttctggtccagaaatgtgcaggtttgggtttgttttttttttttcaattattatactttaagttttagggtacatgtgcacattgtgcaggttagttacatatgtatacatgtgccatgctggtgcgctgcacccactaactcatcatctagcattaggtatatctcccaatgctatccctcccccctgcccccaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcactttttatggctgcatagtattccatgctatatatgtgccacatttacttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtcctttgcccacttttcgatggggttgtttatttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtccttaatccatcttgaattgatttttgtataaggtgtaaggaagggatccagtttcagctttgtacatatggctagccagttttcccagcaccatttattaaatagggaatcctttccccattgcttgtttttctcaggtttgtcaaagatcagatagttgtagatatgcggcgttatttctgagggctccgttttgttccattgatctatatctctgttttggtaccagtaccatgctgttttggttactgtagccttgtaatatagtttgaagtcaggtagcgtgatgcctccagctttgttcttttggcttaggattgccttggcgatgcgggctcttttttggttccatatgaactttaaagtagttttttccaattctgtgaagaaagtcattggtagcttgatggggatggcattgaatctgtacgttaccttggccagtatggtcatgttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgattttgctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcgaagggaatgcttccagtttttgcccattcagtatgatattggctgtgagtttgtcgtagatagctcttattttgaaatacctcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcattccaggaatgaagcccacttgatcatggtggataagctttttgatgtgctgctggattcgttttgccagtattttattgaggatttttgcatcaatgttcatcaaggatattggtctaaaattctcttttttggttgtgtctctgcccggctttgctatcaggatgatgctggcctcataaaatgagttaggaaggattccctctttttctattgattggaatagtttcagaaggaatggtaccagttcctccttgtacctctggtagaattcggctgtgaatccatctggtcctggactctttttggttggtaaactattgattattgtcacaatttcagttcctgttattggtctattcagagattcaatttcttcctggtttagtcttgggagagtgtatgtgtcgaggaatttatccatttcttctagattttctagtttatttgcatagaggtgtttgtagtattctctgatggtagtttgtatttctgtgggatcagtggtggtatcccctttatcattttttattgtgtctatttgattcttctctctttttttctttattagtcttgatagcggtctgtaaattttgttgctcctttcaaaaaaccagctcctggattcattaattttttgaacggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccacgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttcctttggcttggtagatcttcctccatccttttattttgagcctatgtgtgtctctgcacgtgagatgggtttcctgaatacagcacactgatggctcttgactctttatccaatttgccagtctgtgtcttttaattggagcatttagtccatttacatttaaagttaatattgttatgtgtgaatttgatcctgtcattatgatgttagctggttcttttgctcattagttgatgcagtttcttcctagtctcgatggtctttacattttggcatgattttgcagcggctggtactggttgttcctttccatgtttagcgcttccttcaggagctcttgtaaggcaggcctggtggtgacaaaatctctcagcatttgcttgtctgtaaaggattttatttctccttcacttatgaagcttagtttggctggatatgaaattctgggtggaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccatcactttcaagtacaccaatcagacgtagatttggtcttttcacatagtcccatatttcttggaggcttttctcatttctttttattcttttttctctaaacttcccttctcacttcatttcattcatttcatcttccatcgctgataccctttcttccagttgatcgcatcagctcctgaggcttctgcattcttcacgtagttctcgagccttggttttcagctccatcagctcctttaagcacttctctgtattggttattctagttatacattcttctaaattttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggagaggcgctctgtgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggaggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagacgcaggcaggcctcctggagctgtggtgggctccacccagttcgagcttcctggctgctttgtttacctaatcaagcctgggcaatggcgggcgcccctcccccagcctcgctgccaccttgcagtttgatctcagactgctgtgctagcaatcagcgagactccgtggggtagtaccctccaagccaggtgcgggatataatctggtggtgcgccattttttaagctggtccgaaaagcgcaatattcaggtgggagtgacccgattttccaggtgcgtctgtcacccctttctttgactcagaaagggaactccctgacccttgcgcttcccaagtgaggcaatgcctcgccctgcttcggctcgcgcacggtgcgcacacccactgacctgcacccactgtctggcactccctagtgagatgaacccggtacctcagatggaaatgcagaaatcacccgtcttctgcgtcgctcacgctgggagctgtagaccggagctgttcctattcagccatcttggctcctcctctc

SEQ ID NO: 12481 - DNA, 5068 bp, Homo sapiens
aggcaccacattttcttttttttattattattatactttaagttttagggtacatgtgcacaatgtgcagttttgttacacatgtatacatgtgccatgttggtgtgctgcacccatcaactcggcatttagcattaggtatatctcctaatgctatccctcccccctccccccaccccacaacagtccctggtgtgtgatgttccccttcctgtgtccatgtgttctcattgctcaattcccacctatgagtgaggacatgcagtgtttggttttttgtccttgcgatagtttgctgagaatgatggtttccagcttcatccatgtccctacaaaggtcatgaactcatcattttgtatggctccatagtattccatggtgtatatgtgccacattttcttaatccagtctatcattgttggacatttgggttggttccaagtctttgctattgtgaacagtgccgcaataaacatacgtgtgcatgtgtctttatagcagcatgatttataatcctttgggtatatacccagtaatgggatggctgggtcaaatggtatttctgtttctagatccctgaggaatcgccacactgacttccacaatggttgaactggtttacagtcccaccaacagtgtaaaattgttcctatttctccacatcctctccagcacctgttgttgcctgactttttaatgatcaccattctaactggtgtgagattgtatctcattgtggttttgatttgcatttctccgatggccagtgatgatgggcattttttcatgtgtctgttggctgcatagatgccttcttttgagaagtgtctgttcatgtccttcgcccaatttttgatggggttgtttgtttttttcttgtaaatttgtttgagttcattgtagattctggatattagccctttgtcagacgagtaggttgcgaaaattttctcccattttgtaggttgcctgttcactctggtggtagtttctttcgctgtgcagaagctctttagtttaattagatccgatttgtcaattttgtcttttgttgccattgcttttggtgttttagacatgaagtccttgcccatgcgtatgtcctgaatggtattgcctaggttttcttctagggtttttatggttttaggcctaacatgtaagtctttaatccatcttgaattaatttttgtataaggtgtaaggagggatccagtttcagctttctacataaggctagccagtttccccagcaccatttattaaatagggaatcctttccccattgcttgtttttctcaggtttgtcaaagatcagatagttgtggatatgcggcattatttctgagggctctgttctgttccattggtctatatttctgttttggtaccagtaccatcctgttttgtttactgtagccttgtagtatagtttgaagtcaggtagcatgatgcctccagctttgttcttttggcttagaattgacttgacaatgcaggctcttttttggttccatatgaactttaaagtagttttttccaattatgtgaagaaagtcatttgtagcttgatggggatggcattgaatctgtaaattaccttgggcagtatggccattttcacgatattgattcttcctacccacgagcatggaatgttcttccatttgtttgtatcctcttttatttcattgagcagtggtttgtagttctcctcgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgtatcctgagactgcagaagttgcttatcagcttaaggagattttgggctgagagaatggggttttctagatatacaatcatgtcatctgcaaacagggacaatttgacttcctctttccctaattgaatgccctttatttccttcttctgcctgattgccctggccagaacttccaacactatgttgaataggagtggtgagagagggcatccctgtcttgtgccagtattcaaagggaatgcttccagtttttgttcattcagtatgatattggctgtgggtttgtcatagatagctcttattattttgagatacgtcccatcaatacctaatttattgagagtttttagcatgaaggattgttgaattttgtcaaaggccttttctgcatctattgagataatcatgtggtttttgtctttggttctgtttacatgctggattacgtttcttgattttcgtatgttgaaccagccttgcatcccagggatgaagcccacttgatcatggtggataagctttttgatatgctgctggattcggtttgcacagtattttattgaggatttttgcatcaatgttcatcaaggatattggtcgaaaattctctttttttgttgtgtctctgccaggctttggtatcaggatgatgctggcctcatgaaatgagttagggaggattccctctttttctattgattggaatagtttcagaaggaattgaaccagctcctccttgtacctctggtagaattcagctgtgaatccatctggtcctggacgttttttggttggtaagctattaattattgcctcaatttcacagcctgttattggtctattcagagattcaacttcttccttgtttagtcttggaagggtgtatgtgttgaggaatttatccatttcttctagattttctagtttatttgcatagaggtgtttatagtattctctgatggtagtttgtttttctgtgggattggtggtgatatcccctttgtcatttttgattgtgtctatttgattcttctctcttttcttctttattagtcttgctagcagtctttcaattttgtagatcttttcaaaaaaccagctcctggattcattgattttttgaagggtttttcatgtctctatttccttcagttctgctctgatcttagttatttcttgccttctgctagatttggaatgtgtttgctcttgcttctctagttcttttaattgtgatgttaggctgtccattttagatttttcctgctttctcttgtgggcatttagtgctataaatttccatctacacactgctttgaatgtgtcccagagattctggtatgttgtgtctttgttctcgttggtttcaaagaatatctttatttctgccttcattttgttatgtacccagtagtcattcaggagcaggttgttcagtttccatgtagttgagcagttttgagtgagtttcttaatcctgtgttctggtttgattgcactgtggtctgacagacagtttgttataatttctgttcttttacatttgctgaggagtgctttacttccaactatgtggtgaattttggaataggtgtggtgtggtgctgagaagaatgtatattctgttgatttggggtggagagttctgtagatgtctattaggtctgcttggtgcaggaattgcaccaaggaattgaactcctgggtatccttgttaactttctgtctcattgttctgtctaatgttgatagtggggtgttagtctcccattattattgtgtgggagtctatgtctctttgtaggtcactaaggacttgctttatgaatctgggtgcatatatatttaggatagttagttcctcttgttgaattgatccctttaccattatgtaatggccttctttgtctcttttgatctttgttggtttaaagtctgttttatctgagagtaggattgcaactcctgcctttttttgttttccatttgtttggtagatcttcctccatccctttattttgagcctatgtgtgtctctgcacgtgagatgggtttcttgaatacagcacactgatggatcttgactctttatccaatttaccagtctgtgccttttaattggagcatttagcccatttacatttatggttagtattgttatgtgtgaatttgatcctgtcattatgatgttaggtagttattttgcttgttagttgatgcagtttcttcctagcctcgatgatctttacaatttgtcatgtttttgcagtggctggtaccggttattcctttccatgtttagtgcttccttcaggagctcttttagggcaggcgtggtggtgacaaaatctctcagcatttgtttgtctgtaaagtatgttatttctccttcacttatgaagcttagtttggctgtatatgaaattctgggttgaaaattcttttcttgaagaatgttgaatattggcccccactctcttctggcttgtagactttctgccaagagatcagctgttagtctgatgggcttccctttgggggtaacccgacctttctctctggctgcctttaacattttttccttcatttcatctttggtgaatctgataattatgtgtcttagagttgctcttcttgaggagtatctttgtggcattctctttatttcctgaatttgaatgctggcctgcgttgctagattggggaagttctcctggataatatcctgcagagtgttttccaacttggttccattctccccgtcactttcaggtacaccaattagacgtagatttggtcttttcacatagtcccatatttcttggaggctttgttcatttctttttattcttttttctctaaacttctcttcacgcttcatttcattcctttagtcttccatcactgataccctttcttccagttgattgcatcagttactgaggcttgtgcattcatcacgtagttctcgtgccatggttttcagctctatcaggtcctttaaggacttctctgcatcggttattctagttatccattcatctaatattttttcaaagtttttaacttctttgtcattggttcgaacttcctcctttagttcagagtagtttgatcttctgaagccttcttctctcaattcgtcaaagtcattctccgtccagctttgttccgttgctggtgaggagctgcgttcct

SEQ ID NO: 12482 - DNA, 6620 bp, Homo sapiens
tggccagttatagaattttcttttcttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccctaccccaccacagtccccagagtgtgatattccccttcctgtgtccatgtgatctcattgttcaattcccacctatgagtgagaatatgcggtgtttggttttttgttcttgtgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgttctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcgttatttctgagggctctgttctgttccattgatctatatctctgttttggtaccagtaccatgctgttttggttattgtagccttgtagtaaagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctagtcctggactctttttggttggtaagctattgattattgccacaatttcagctcctgttattggtctattaagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgctatcccctttatcattttttattgtgtctatttgattcttctctctttttttctttattagtcttgctagcggtctatcaattttgttgatcctttcaaaaaaccagctcctggattcactgattttttgaagggttttttgtgtctctattttcttcagttctgctctgattttagttatttcttgccttctgctagcttttgaatgtgtttgctcttgctttctagttcttttaattgtgatgttagggtgtcaattttggatctttcctgctttctcttgtgggcatttagtgctaaaaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggtacgggttgttcctttccatgtttagcgcttccttcaggagctcttttagggcaggtctggtggtgacaaaatctctcagcatttgcttgtctgtaaagtattttatttctccttcacttatgaagcttagcttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctaaattggggaagttctcctggataatatcctgcagagtgttttccaacttggttccattctccccatcactttcaggtacaccaatcagatgtagatttggtcttttcacatagtcccatatttcttggaggctttgctcatttctttttactcttctttctctaaacttcccttctcgcttcatttcattcatttcatcttccattgctgacaccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttggaggaggagaggcgctctgatttttggagcttccagtttttctgttctgttttttccccatctttgtggttttatctacttttggtctgtgatgatggtgatgtacagatgggtttttggtgtggatgtcctttctgtttgttagttttccttctaacagacaggaccctcagctgcaggtctcagatggaaatgcagaaatcaccggtcttctgcgtcggtcacgctgggagctgtagaccggagctgttcctattcggccatcttggctcctccccgaatgtatccagttatagaattttctatctgtcccagtggccactgagcatagtttggttgcactgtatctaatggatttcagaaaattggaatgaattgaagaatcctgataccacatttcatactcagcttccagataatttctctttattgtttttattttgttttgttttgctttggtggcagtagaatttattagaatgtgccttttaaaaattatttgaaatagagatggagtcttgctttgttgctcaggatggtcttgaattcatagcctaaaatgatcctcacaccttggcctcccaaagtgctgaggttacaggcatgagcctagaatgtggcttaatacaggcacgtgggcttgcccacggtgctctcagtatataaagcttgaatgtcttggcaatttttcttgagtaatgacactaggaagttgacagccaggtgaatgttatgtacaagctcatcgtctgtcatcttcacatggccaacagccacagccagacatagcaccttcttcatctgaaactgggttgtggacttcacctcatccactttggccaccatgtttttgttgtgtgtcagcaggggagggaacttacccaccttatttaggcctgggccaaggattcatgggatctgcttgatcagagactctgaggctaaaaagacattatactttttgacagctgtttgaccgattattattcttattgagcttttcagcaccttgatgtccctgtggaggatatccacagccttgagccattttttttttttttggagacagggtctcactttgtcatccaggctggagtgcagaggctcgaacatagctcactgcaacctcgacttcccaggctcaagcagtcctcccacctcagcctcctgagtagctgggactacaggcgtacatcaccatgtccagctaattttgtgtattttttgtagagacagggtttcaccatgttgcccaggttggtcctgagctcctggaatcaagcgatcctcctgccttggcctcccaaagtgctgggattacaggcatgaatcactgtgcctggcccatcttatttttctttaataaattattttctgtttgtagaaataggatctggctatgttgcccaggctgtctcaaactcctggcctcaaacaatcctctccactcagcctctcaaagtgctgggattacaggtgtgagccaccttgcttgccctcttttttttctttaaatcagagtattttg

SEQ ID NO: 12483 - DNA, 6057 bp, Homo sapiens
ttttacttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatatgatctcattgttcaattcccacctatgagtgagaatatgcggtgtttggttttttgttcttgtgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgtggtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctgacgtttaaatctttaatccattttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattcagtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagaacctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagatttttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcacccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctccacaatttttttttttt

SEQ ID NO: 12484 - DNA, 10960 bp, Homo sapiens
ggtgtatatgtgtcacattttctttatccagtctaacgttgatgggcatttgggttggttctaagtctttgctattgtgaatagtgctgcaataaacataggtgtgcatgtgtctttatagaagaatgatttataatcctttgagtatatactcagtaataggattgctgggtcaaatggtatttctagttctagatccttgaggaattgccacactgtcttccacaatggttgaactaatttacactcctaccaacagtgtaaaagcgtttctatttctccacatcctctgcagcatctgttgtttcctgactttttattgatcgccattctaactggtgtgagatggtatctcattgtggttttgatttgcatttctgtaatgaccagtgatgatgagcattttttcatgtgtctgttgactgcataaatgtcttcttttgagaagtgtctgttcgtatcctttgcccactttttgatggggttggttttttcttgtaaatttgtttaagttatttgtagattctggatattagccctttgtcagatggctatattgcaaaatttttctccaattctgtaggctgcctgttcactctgatggtagtttcttttgctgtgcagaagctcttaagtttcattagatcccatttgtcaattttggcttttattgccattgcttttggtgttttagtcatgaagtccttgcccatgcctgtgtcctgaatggtattgcctaggttttcttctagggtttttatggttttaggtcttacatttacatctttagtgcatcttgaattaatttttgtatacggtgtaaggaagggatccagtttcagctttctacatatggctagccagctttcccagcagcatttattaaatagggaattctttccccatttcttgtttttgtcaggattatcaaagatcagatggttgtagatgtgtggtgttatttctgaggcctccgttctgctccattggtctatctctctgttttggtaccagtaacatgctgttttggttactgtagccttgtagtatagtttgaagtcaggtagcatgatgcctccagctttgttctttttgcttaggattgtcttggcaatttgggctcttttttggttccatatgaactttaaagtaggttttttcaattctatgaaggaagtcattggtagcttgatggggatggcattgaatctataaattaccttgggcagtatggttattttcacaatactgttcctcctatccatgagcatggaatgtttttccatttgtttgtgtcctctcttatttccttgagcagtggtttgtagttctccttgaagagttccttcacattccttgttagttggattcctaggtattttattctctttgtagcaactgtgaatgggagttcactcatgatttggctctctgtctgctattggtgtgtagaaatgcttgtgatttttgcacattgattttgtatcctgagattttgctgaagttgcttatcagcttaaggagattttgggctgagacaatggggttctctaaatatacaatcatgtcatctgcaaacagggacaatttgatttcctcttttcctaactgaataccctttatttctttctcctgcctgattgccctggctagaacttccaacaccatgttgaataggagtggtgagagagggcatccctgtcttgtgccagttttcaaagggaatgcttccggtttttgtccattcagtatgatattgcctgtgggtttgtgataaatagttcttattattttgagatacgttccatcaatacctagtttattgagagtttttagcatgaagggctgctgaattttgtcgaaggccttttctgcatctattgagataatcgtgtggtttttgtcattgattctgtttatgtgatggattatgtttattgatttacatatgttgagccagcctcgcatcctggggatgaagccgacctgattgtggtggataagctttttgatgtgctgctggattcagtttgccagtattttattgagaattttcacattggtgttcatcagggatattggtctaaaattctctttttttttgtcgtgtctttgccaggctttggtatcaggatgatgctggcctcatataatgagttaaggaggattctctctttttttgtttggaatagtttcagaaggaatggtaccagctcctttttgtacctgtggtagaattcggctgtgaatccctctggtcctggacttgttttggttggtaggatattaattattgcctcaattttagagcctgttaattggtctattcagagattcaacttcttcctggtttagtcgtgggaggatgtatgtgttcagaaatttatccatttcttctacattttctagtttatttgcatagaggtgtttatagttttctctgatggtagtttgtatttctgtggtattggtggtgatatcccctttatcattttttattgcatctatttgattcttctctcttttcttctttattagtcttgctagcagtctaccagttttgttgatcttttcaaaaaccagctcctggattcattgactttttgaagggttttttttttgtttttttttgtttttttggtctctctttcagttctgctctgatattagttatttcttttctgctagcttttgaatttgtttgctctttcttctctagttcttttaatactgacattagggtgtggattttagatctttcctgctttctcttctggacatttagtgctataaatttccctctacacactgctttgaatgtgtcccatagattctgatacattgtgtccttgttctcattggtttcaaagaacatctttatttctgccttcattttgctatttacccagtagtcattcaggagcaggttgttcagtttgcatgtagttgtgcagttttgagtgagtttcttaatgctgagctctaatttgattgcactgtggtcttagagacagtttgttctgatttcttttcttttacatttgctgagaagtgctttactttcaactatgtggtcaattttggaataagtgcaatgtggtgctgagaagaatgtatattctgtttatttggggtggagagttctgtagatgtctattaggtccgcttggtgcagagctgagttcaagtcctggatatccttcttaaccttctgtctcattgatctaatactgatggtggtgtgttaaagtctcccattattattgtgtgggagtctaagtctctttttaggtctctaaggacttgctttatgaatctgattgctcctgtattgagtgcatatatatttaggatagttagctctttttgatgcattgatccttttatcattatgtaatggccttctttgtcaatggccttctgtgtctcttctgatctttgttggtttaacgtctgttttatcagagagtaggattccaacccctggtttttttgctttccatttgcttggtaggtcttcctccttctctttattttgagcctatatgtgtctctgcacaagagatgggtctcctgaatacagcacactgatggttcttgactctacccaatttgccagtctgtgtcttttaattggagtatttagtccatttacatttaaggttaatattgttatgtgtgaatttgatcatgtcattatgatgttagctggttattttgctcattagttgatgcagtttcttcctagtatcaatggtctttacaatttggcatgtttttgcagtggttggtactgtttgttcctttccatgtttcgtgcttccttcaggagcccttgtaaggcaggcctggtggtgacaaaatctctcagcatttgcttggctgtaaaggattttatttctccttcacttatgaagcttagtttggctggatatgaaattctgggttgaaaattcttttctttaagaatgttgaatattggccccactctcttctggcttgtagagtttctgtggagagatccactgttagtctgatgggcttccttttgtgggtaaccctacatttttctgtggctgccccaacattttttccttcatttcaaccttggtgaatctgataattatacatcttggggttgctgttctcaaagagtatctgtcgtgttctctgtatttcctgaatttgaatgtcggcctgccttgctagattggggaagttctcctggataatatcgtgcagagtgttttccagcttggttccattatccctgtcactttcagatacaccaatctaacgtagatttggtcttttcacatagtcccatatttcttggaggctttgttcgtttctttttacttttttctctaaacttctcctcttgctttatttcattaatttgatcttcaatcactgataccctttcttccacttgattgagttggctattgaagcttgtgcatgcatcacgtagttcttgtgccatggtgttcagctctatcaggtcatttaatgtcttctctacactgtttaatctagttagccattcatctaatctttttttcaatgtttttagcttccttgcaatgggttccaacatcctcctttagcttggagaagtttgttattaccgaccttctgaagtctacttctgccagcttgtcaaattcattctccatccagttttgttccgttgctggtaaggatctgcgatcctttggaggagaagaggtggtctggtttttagaattttcagcttttctgccatggtttctccccatctttctggttttttaaaattattattattataccttaagttttagggtacatgtgcacaatgtgcaggttagttaacatatgtatacatgtgccatgctggtgtgctgcacccattaactcatcatttagcattaggtatatctcctaatgctatcccttccccctccccccacaccacaacagtccccagagtgtgatgttccccttcctgtgtccatgtgttctcattgttcaattcccacctatgagtgagaatatgctgtgtttggttttttgttcttgcgatagtttactgagaatgatgatttccaatttcatccatgtccctacaaaggacatgaactcatcattttttatgtctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttatagtcctttgggtatatacccagtaatgggacagctgggtcaaatggtatttctagttctaaatctctgaggaattgccacattgacttccacaatggttgaactagtttacagtcccaacaacagtgtaaaagtgttcttatttctccacatcctctccagcacctgttgtttcctgactttttaatgattgccattgtaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgattgagttcattgtagattctggatattagccctttgtcagatgagtaggctgcaaaaattttctcccattttgtaggttgcctgttcactctgatggtagtttctgttgctgtgcagaagctctttagtttaattatatcccatttgtcaattttgtcttttgttgccattgcttttggtgttttagacatgaagtcctttcccaagcctatgtcctgaatggtaatgcctaggttttcttctagggtttttatggttttaagtctaacatttaagtctttaatccatcttgaattaatttttgtataaggtgtaaggaagggatccaatttcggctttctacatatggctagccagtttccccagcaccatttattaaatagggaatcctttccccatggcttgtttttctcaggtttgtcaaagatcagatagttgtagatatgcggcgtcatttctgagggctctgttctgttccattgatctatatctctgttttgataccccagtaccatgttgttttggttactgtagccttgtagtatagtgtgaagtcaggtagtgtgatgcctccagctttgttcttttggcttaggactgacttggcgttgcgggctcttttttggttccatatgaactttaaagtagttttttccaattctgtgaagaaagtcattggtagcttgatggggatggcattgaatctataaattaccttgggcagtatggccattttcacgatattgattcttcctacccgtgagcatggaatgttcttccatttgtttgtatcctcgtttatttcattgagcagtggtttgtagttctccttgaagaggtccttcacgtcccttgtaagttggattcctaggtattttattctctttgaagcaattgtgaatgggagttcactcatgatttggctgtttgtctgttattggtgtataagaatgcttgtgatttttgtacattgattttgtatcctgagaccttgctgaagttgcctgtcagcttgaggagattttgggctgagacaatggggttttctagatatacaatcatgtcatctgcaaacagggacaatttggcttcctcttttcctaattgaataccctttatttccttctcctgcctaattgccctggccagaacttccaacactatgttgaataggagtggtgagagagggcatccctgtcttgtgccagttttcaaagtgaatgcttccagtttttgcccattgagtatgatattggctgtgggtttgtcataggtagctcttattattttgagatacgtcccatcaatacctaatttattgagagtttttagcaagaagggttgttgaattttgtcaaaggcctttactgcatctattgagataatcatgtggtttttgtctttggttctgtttatatgctggattacatttattgatttgcgtatattgaaccaaccttgcatcccagggatgaagcccacttgatcatggtggataagctttttaatgtgctgctgggttcggtttgccagtattttattgaggatttttgcatcaatgttcatcaaggatattggtctaaaattctcttttttggttgtgtctctgcccggctttggtatcaggatgatcctggcctcataaaatgagttagggaggattccctctttttctattgattggaatagtttcagaaggaatggtaccagttcctccttgtacctctggtagaattcagctgtgaatccatctggtcctggactctgttaggttggtaagctattgattgttgccacaatttcagctcctgttattggtctattcagagattgaatttcttcctggtttagtcttcggagggtgtatgtgtcgaggaatatatccatttcttctagattttctagtttattttcatagaggtgtttgtaatgttctctgatggtagtttgtatttctgtgggatcagtggtgatatcccctttatcgttttttattgcgtctatttgattcttctctcttttcttctttattagtcttgctagtggtctatcaattttgttgatcctttcgaaaaaccagctcctggattcattaattttttgaagggttgtttgtgtctctatttcctgcagttctgctctgattttagttatttcttgccttctgctagcttttgaatgtgtttgctcttgcttttctagttcttttaattgtgatgttagggtgtcaattttggatctttcctgctttctcttgtgggtatttagtgctataaatttccctctacacactgctttgaatgtgtcccagagattctggtatgttgtgtctttgttctcgttggtttcaaagaacatctttatttctgccttcattttgttatgtacccagtagtaattcaggagcaggttgttcagtttccatgtagttgagtggttttgagtgggtttcttaatcgtgagttctagtttgattgcactgtggtctgagagacagtttgttataatttctgttcttttacatttgctgaggagagctttacttcccagtatgtggtcaattttggaataggtgtggtgtggtgctgaaagaaatgtgtattttgttgatttggggtggagagttctgtagatgtccattaggtctgcttggtgcagagctgagttcaattcctgggtatccttcttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgatttgatccctttaccactatgcaatggccttctttgtctcttttgttctttgttggtttaaagtctgttttatcagagactaggattgcaaccctgcctttttttgttttccatttgcttggtagatcttcctccatccttttgttttgagcctatctgtgtctctgcacgtgagatgggtttcatgaatacagcacactgatgggtcttgactctttatccaatttgccagtctgtgtcttttatttggagcatttattccatttacatttaaagttaatattgctttgtgtgaatttgatcctgtcattatgatgttagctggttattttgctcgttagttaatgcagtttcttcctagccttgatggtctttacaatttggcatgattttgcagtggctgttaccggttgttcctttccatgtttagtgcttccttcaggagctcttttagggcaggcctggtggtgacaaaatctctcaacatttgcttttctgtaaagtattttatttctccttcacttatgaagcttagtttggctggatatgaaattctgggttgaaaattcttttctttaagaatgttgaatgttggccctcactgtcttctggcttgttgagtttctgtgaagggatcagcagttagtctcatgggcttccctttgtgggtatcccgacctttctctctggcttcccttaacattttttccttcatttcaactttggtgaacctgacaattatgtgtcttggagttgctcttctcgaggagtatctttgtggtattctctgtatttcctgaatctgaatgctggcttgccttgctagattgggtaagttctcctggataatatcctgcagagcgttttccaacttggttccattctccccatcactttcaggtacaccagtcagatgtagatttggtcttttcacatagtcccatatttcttggaggctttattcatttctttttattgttttttctctaaacttcccttctcgcttcatttcattcatttcatcttccatcactgataccctttcttccatttgattgcatcggctcctgaggcttctgcattcttcacgtagttcttgagccttggctttcagcatcttcagctcctttaagcacttctctgtattggttattctagttatacattcgtcttaatttttttcaaagtttttaacttctttgcctttggtttgaatttcctcctgtagctcagagtagttttgtcatctgaagctttcttctctcaactcatcaaagtcattctccgtccagctttgtttcattgctggtgaggaactgcattcctttggaggaggagaggtgctctgctttttagagtttccagtttttccaatttttctgctctgttttttccccatctttgtggttttatctgcttttggtctttgatgatggtgatgtacagatgggtttttgatgtggatgtcctttctgtttgttagttttccttctgacagacaggaccctcagctgcaggtctgttggagtttgctagaagtccactccagaccttgtttgcctgggtaccagcagcggtggctgcagaatagcagattttcgtgaaccgtgaatgctgctgtctgatctttcctctggaagttttgtctcagaggagtacccggccgtgtgaggtgtcagtctgcccctactgggggtgtctcccagttaggctgctcgggggtcagggttcagggacccacttgaggagtcagtctgcccgttctcagatctccagctgtgtgctgggagaaccactgctctcttcaaagctgtcagacagggacatttaagtctgcagaggttcctgctgtctttttgtttgtctgtgccctgcccccagaggtggagcctacagaggcaggcaggcctccttgagctgtggtgggctccacccagttcgagtttcctggctgctttgtttgcctaagcaagcctgggcaatggcaggcgctcctcccccagcctcactgtcgccttgcagtttgatctcagactgctgtgctagcaatcagcgagactccatgggcataggaccctccaagccaggtgtgggatataatcttctgttgtgccgttttttaagcctgtccgaaaagtgcagcattagggtgggagtgacccaattttccagatgccatctgtcacccctttctttgactaggaaagggaactccttgaccctttgcgcttcccaagtgaggcaatgcctcgccctgcttcagctcgtgcacggtgcactgcacccattgtcctgtgcccactctctggcactccctagtgagatgaacccggtacctcagatggaaatgcagaaatcacccatcttctgcatcgctcacgttgggagctgtagaccagagctgttcctgttcagtcatcttggctccatcc

SEQ ID NO: 12485 - DNA, 11002 bp, Homo sapiens
tggatctttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagttgtggatcttttaccacctatgtctcccctttcatttggtcttccctcagaagtgcacgcaaagagtattctttttcagtatcctgcttcactgatattgccagaatcattacctgtgttgcttaatcaaagagaatttatcgttgtctggtttctgttagaaaccactgtatcagattttggccttaggtacacctgagcaacatcaccaagaaaatggttgcagaggagacaatgataccttgggagctgtacatgatctagccaacagccctgcctctttcttgttgcagtcagcttcatcatcagatagaaacaatgctacaccacttgaaaaggacaggaagatgagaactcccaaagagaaaaataaaacaatttctaagaaaataccagattttgaagtggaagattctccattatcagatgtcgcaaagaacagagagtagtgcatttggagggtctctgccagctaaaaaaaagtggtcagttccaaaaaaaagcaagatcatctgctagaaggggttgttggagcagttttatttggttcaccacagctctgtgagagaaaataagtaaatttaggggaactaattgactctctaggttctaacctcttctgaacaaggaaccagatttcccatacccataaaacttgacaatggaaattaggagctcatggagaaaaactattgaaatggaagaaaacagaactacagaaccaattcaaacggatactgagcacagagaagtattgctgggatcattacctgatttgtgtaatcaaagaggatttagcatagtcggttttctcttaaaccactgtatgagatttcggccagtctcatttgactgaaatgagactgcaagtgtgtgcctcagaaatacatggtgatcaatcatatgggtgaaccaccaatacaaaatcagtctgatttgttgagtaagaaaataatttgcgcccagcaaggtggctcacgcctgtaatcccagcactctgggaggccgaggcgggcggatcacgaggtcaggagatagagaccatcctggctaacacggtcaaaccctgtctctactaaaaatacaaaaaattagcagggcatggtggtgggcgcctgttgaggcaggagaatggcatgaacccaggaggcggagcttgccgtaagccaagatcatgccactgcactccagcctgggtgacagagccagactgtgtctcaaaaaaaaaaaaataataataatttgcaagcaagatttggaatgtacagctttaccaaccaagctttcagaaactagccaagaagacattctcccctgccatcagcaatgggatagatgagctgggtagcagtaaagaggagtatatgaaaatattggaccattcacaggattcctgtaacaaaccttccatgaataacactacattatggaactcttttcagatatcaagcggaattagttctaagagttgtaaggatattgattttagcatatttacatttggcatgaaacttttccggaggaaggtggtcccctaagtgttaaaagttccagtagcttagagtccagtttaaactagagccaaatagtcctgtggacagtggcatttttctaggagatattatggtagatggacaaactactccagaatcagacttcaatctataggctgtttgcagtagatatgaggctctgaagaaatctttttccaagaaaagggaagaattttacctgtctaatcttgaaacacttgaaagacacaaaccagaattgagccctactccccaaaatgtgcaaacagatgatatgcttaactatttggacactcatgatgtgcacattgaatatgcaaaaccacatttacacatgtcccttggtgaaagaaaagtctctttcaccactaattaagtttcctccagtggaacaaagattgaccacaataccatgtagttttggagaacttctacctaattcaaacgaagaagacatcttgaataagagccttgatgcaacagaatctttgtctgacttgacaagatgaagcaatacggagttaatataactatgatgtacttagactgaagctatgcaacagaatagaaactgatttataagttaaatacatgttggaagtgtaacattattcttcaaggtctaaaaaattctaaatgccttttagcctcctgtagtatttttaggtaaggaaagtatgttgaattatttctctttgtagggatatagggttgaaatgtgaagtatttggaaagcaaatgtcaagcaatgggaagccattttgatttcttgagtacccttgcaaacattaagtgacaaaagtagcttaactaatttattataatttcagttagttaacataaggatgtgtagtttttgttgtacctttactaagtggttaatataatagccattgaagttactgatctttcattttaaagaaatatacaacttttattgttttttgtttctgtttttttttgagacagagtctcgccctgttgcccaggctggagtgcggtggtgcgatctcagctcactgcagcctctgcctccggggttcaagtgatgcttatgcctcagccacctgagtagctgggactacaggcgcacatcaccatgctcatccaatttttgtattttcagtagagatggggttttaccatgttggccaggctggtctcgaactcctggtctcaagtgatccacccgccttggactcccaaagtgctggagttacaggcatgacccactgcacctgaccttttattctttctttatgggacattctgtattaaccagaaaaagtgagaaaggccttgggatgtgtagtcacacatgacatcacacacgttgtgtgtgatgacaaattttaagactgggaaagctctaaacgggcttaatgattattcaaatagattgattttgagaaatgatgtttggtggagtaaagtgcatgtgatgataagtgaagactggggcagaatgattttaaagaagaaaaaagatggaactctcatcttttccttttaagaaggtgcttaaaaggaaccgtcaaactacaaatccattcagtgggtggtgtaacgtttatattgagtctaatttagtctaatatttagtctcatatttaaactaaatataaatcctagttttacattttaacaaaaatataaatcaaaaatttcattagtttgtttaaaaatatattgtatatatacacatatgtacatatcaagatctattgaagctaatgaaaacaataaatttgaactaaatagaggagaaaagattgatagatcagagaaaagaaagttaaacttaagatatatactatgttctcaatatgccgtagcaaatacttctttgctttctgtatactttgtacaggtagtcaacattttacccttgagaaattgtgttttttcatatctcaaaagagctttgactctcattatgcacttaaccttaagtgcattttataatgtagacaattataaaaagaataacaattcccttgcctctggagtagctaaaatttctaatgatccttcttttaacatctacagtgttgattataaggtaccaaaacttcagttattcacccaggctagatggtgaccttctcttgatctcatgtacctatgctcctgtgttcaactggtagtgctcacagatattccccttgtccaatatcaggactcaaatttagaccttcagagagtgacaggcatctcttgcatgcagactagcgttggccttcacaagtagctgctcttttgcaccaaatatttgctgtcttactttgcttatgtaatctctggcacgacacacatacagaaagaaagacagcattttagtaataattagcctcgattagtatgctttagagtctttcagaattactctacaatattgtaaaagagatttcattttatggtgttcaggtaaagaaagtagcttatacttccatttggaggcctattgtaactatttagatagatttttatatgtgtgaaatgtggtctagataaatatatttcaatgattctgtgcatgttgttaggaagggcagaaccatgcccacgtgtaaatatgtatgcaatgactgtctgcagaaggacttgtatataccttgcctcttgatggtatttgggccacactgtacaaaacaatgccttcacagccttcactgtgaaatattaatggttaaagctctgctacctcttcagggaccaatcatgggagaagaagaattgtgttaggtaatcttgagctagattattgcaaggcactcaggaagtgtgccaatgcttcttcacaagaagccctctaattgatccagaatggcatgtcgttgaataagcttggcaatggatttcatatcaagtttagtcagtggatatttgctcaaacctctctggaaagggccccaccaagagccaacttcaaacatggtgtccagccctgaggtatctgcctcccactgtaaggaaatgtgttcctcacatatttaacaacatcttgtttttttttattttattattattatactttaagttttagggtacatgtgcacaatgtgcaggttaattacatatgtatacatgtgccatgctggtgtgctgaacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaaaccagtctatcattgttggacatttgggttggttccaagtctttgctattgtgaatagtgccgcaataaacatacatgtgcatgtgtctttatagcagcatgatttaagtcctttgggtatatacccagtaatgggatggccgggtcaaatggtatttctagttctagatccctgaggaatcgccacactgacttccacaatggttgaactagtttacagtcccaccaacagtgtaaaagtgttcctatttgtccacatcctctccagcacctgttgtttcctgactttttaatgattgccattctaactggtgtgagatggtatcttattgtggttttgatttgcttttctctgatggccagtgatggtgagcatgttttcatgtgttttttggctgcataaatgtcttcttttgagaagtgtctgttcatgtccttcacccactttttgatggggttgttcgttttttccttgtaaatttgtttgtgttcattgtagattctggatattagccctttgtcagataagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagtcatgaagtccttgcccatgcctatgtcctgaatggtaattcctaggttttcttctagggtttttatggttttagatctaacgtttaagtctttaatccgtcttgaattaatttttgtataaggtgtaaggaagggatccagtttcagctttctacatatggctagccagttttcccagcaccatttattagatagggaatcctttccccattgcttgtttttctcaggtttgtcaaagatcagatagttgtagatacgcagcgttatttctgagggctctgttctgttccattgatctatatctctgttttgataccagtaccatgctgttttggttactgtagccttgtagtatagtttgaagtcaggtagcatgatgcctccagctttgttcttttggcttaggattgacttggcgatgcgggctctttattggttccatatgaactttaaagtagttttttccaattctgtgatgaaagtcattggtagtttgatggggatggcattgaatctataaattacctcggacagtatggccattttcatgatattgattcttcctacccatgagcatggaatgttcttccatttatttgtatcctcttttatttccttgagcagtggtttgtagttctccttgaagaggtccttcacatcccttgtaagttggattcctaggtattgtattctctttgaagcaattgtgaatgggagttcactcatgatttggctctctgtttgtctgttaattggtttataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttcttctgcctaattgccctggccagaacttccaacactatgttgaataggagtggtgagagagggcatccctgtcttgtgccagttttcaaagggaatgcttccagtttttgcccattcagtatgatattggctgtgggtttgtcacagatagctcttattattttgagatatgtcccatcaatacctaatttattgagagtttttagcatgaagcgttgttgaattttgtcaaaggccttttctgcatcttttgagataatcatgtggtttttgtcgttggttctgtttatatgctggattacatttattgatttgcgtatattgaaccagccttgcatcccagggatgaagcccacttgatcatggtggataagctttttgatgtgctgctggattctgtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttcattggtaagctattgattattgccacaatttcagagcctgttattggtctattcagagattcaacctcttcctggtttagtcttgggagggtgtatgtgtcaaggaatttatccatttcttctagattttctagtttatttgcgtagaggtgtttgtagtattctctgatggtagttcgtatttctgtgggatcagtggtgatatcccctttatcattttttattgcatctatttgattcttctctcttttcttctttattagtcttgctagcagtctatcaattttgttgatcctttcaaaaaaccagatcctggattcattaattttttgaagggtttttttgtctctatttccttcagttctgctctgattttagttatttcttgccttctgctagcttttgaatgtgtttgctcttgcttttctagttcctttaattgtgatgttagggtgtcaattttggatctttcctgctttctcttgtgggcatttagtgctataaatttccctctacacactactttgaatgtgtcccagagattttggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgatcttttacatttgctgaggagagctttacttccaagtatgtggtcaattttggaataggtgtggtgtggtgctgaaaaaaaatgtatattccgttgatttggggtggagagttctgtagatgtctattaggtctgcttggtgcagagctgagttcaattcctgggtatccttgttaactttctgtctcgttgatctaatgttgacagtggggtgttaaagtctcccattattattgtgtgggagtctaagtctctttgtaggccactcaggacttgctttatgaatctgggtgctgctgtattgggtacatatatatttaggatagttagttaggtcttcttgttgaattaatccctttaccattatgtaatggccttctttgtttcttttgatctttgttggtttaaagtctgttttatcagagactaggattgcaacccctgcctttttttgttttccatttgcttggtagatcttcctccatccttttattttgggcctatgtgtgtctctgcatgtgagatgggtttcctgaatacagcacactgatgggtcttgactctttattcaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattcaaaattcttttctttaagcatgttgaatattggcccccactctcttctggcttgtagagtttctgccgagagatccgctgttagtctgatgggcttcactttgtgggtaacccgacctttctctctggctgcccttaacattttttccttcatttcaactttggtgaatctgacaattatgtgtcttggagttgctcttctcgaggagtatctttgtggcattctctgtatttcctgattctgaatgttggcctgccttgctagattggggaagttctcctggataatatcctgcagagtgttttccaacttggttccattctccccatcactttcaggtacaccagtcagacgtagatttggtcttttcacatagtcccatatttcttggaggctttgttcgtttctttttattcttttttctctaaacttcccttctcgcttcatttcattaatttcatcttttatcactgataccctttcttccagttgatcgcatcggctcctgaggcttctacattcttcacatagttctcgagccttgcctttcatctccatcagctcctttaggcacttctctgtattggttattctagttatacattcgtctaaatttttttcaaagttttcaacttgtttgcctttggtttgaatttcctcctgtagctcggagtagtttgatcgtctgaagccttcttctctcaactcgtcaaagtcattctccgtccagctttgttctgttgctggtgaggaactgtgttcctttggaggaggagaggcgctctgctttttagagtttccagtttttctgctctgttttttccccatctttgtggttttatctacttttggtctttgatgatggtgatgtacagatgggtttttggtggatgtcctttctgtttgttagttttccttctaacagacaggaccctcagctgcaggtctgttggagtttgctagaggtccactccagaccctgtttgcctgggttccagcagcggtggctgcagaacagtggattttcgtgaacctcgaatgctgctgtctgatcattcctctggaagttttgtctcagaggagtacccggtggtgtgaggtgtcagtctgcccctactggggggtgcctcccagttaggctgctcgggggtcaggggtcagggacccacttgaggaggcagtctgcctattctcagatctccagctgtgtgctgggagaaccgctgctctcttcaaagctgtcagacagggacatttaagtctgaagaggttactgctgtcttttcatctgtgccctgcccccagaggtggagcctatagaggcaggcaggcctccttgagctgtggtgggctccacccagttcgagcttcccggctgctttgtttacctaagcaagcctgggcaatggcgggcacccctcccccagcctcactgccgccttacagtttgatctcagactgctgtgctagcaatcagcgagactccgtgggcgtaggaccctctgagccaggtgtgggatataatctcctggtgtgccattttttaagcccattggaaaagcgcagtattcgggtgggagtgacccgattttccaggtgccgtctgtcacccctttctctgactaggaaagggaactccctgaccccttgcacttcctgagtgaggcaatgcctcaccatgctttggcttgcgcatggtgcgctgcatccactgtcctgcacccaccgtctggcactccctagtgagatgaacccggtacctcagatggaaatgcagaaatcagccatcttctgcattgctcatgctgggagctgtagaccggagctgttcctatttggccatcttggctcccg

SEQ ID NO: 12486 - DNA, 5310 bp, Homo sapiens
atatattgttattttattttattttattttattattattatactttaagttttagggtacacgtgcacaatgcgcaggttagttacatatgtatacatgtgccatgctggtgtgctgcacccattaactcgtcatttagcattaggtatatctcctaaagctataccccctcccctcaccccacaacagtccccagagtgtgatgttccctttcctgtgtccatgtgttctcattgttcaattcccacctatgagtgagaatatgcggtgtttggttttttgttcttgcaatagtttactgagaatgatgatttccaaattcatccatgtccctacaaaggacatgaactcatcattttttatggctgcatagtattccatggtgtatatgtgccacattttcttaatccagtctatcattgttggacatttgggttagttccaagtcgttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagcgttcctatttctccacatcctctccagcacctgttgtttcctgactttttaatgattgccattctaactggtgtgagatggtatctcattgtggttttgatttgcatttttctgatggccagtgatggtgagcattttttcatgtgttttttggctgcataaatgtcttcttttgagaagtgtctgttcatgtccttcgcccactttttgatggggttgtttgatttttcttgtaaatttgtttgagttcattgtagattctggatattagccctttgtcagatgagtaggttgcgaaaattttctcccattttgtatgttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatgctattgcctaggttttcttctaggggttttatggttttaggtctaacatttaagtctttaatccatcttgaattaatttttgtataaggtgtaaggaagggatccagtttcagctttctacatatggctagccagttttcccagcaccatttattaaatagggaatcctttccgcattgcttgtttttgtcaggtttgtcaaagatcagatagttgtagatatgcggtcttatttctgagggctttgttttgttccattgatctataactctgttttggtaccagtaccatgctgttttggttactgtagccttgtaggatagtttgaagtcaggtagcgtgatgcctccagctttgttcttttggcttagggttgacttggcgatgcgggctcttttttggttccatatgaactttaaagtagttttttccaattctgtgaagaaagtcattggtagcttgatggggatggcattgaatccgtaaattaccttgggcagtacggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcatttgtgaatgggagttcactcatgatttggctctctgtttgtctgttattggtgtataagaatgcttgtgatttttgcacattgattttgtatcctgagactttgatgaagttgcttaccagcttaagaagattttgggctgagacaatggggttttctagatatacaattatgtcatctgcaaacagggacaatttgacttcctcttttcctaattgaataccctttatttccttctcctgcctaattgccctggccagaacttccaacactatgttgaataggagtggtgagagagggcatccgtgtcttgtgccagttttcaaagggaatgcttccagtttttgcccattcagtatgatattggctgcgggtttgtcatagatagctcttattattttgagatatgtcccatcaatacctaatttattgagagtttttagcatgaagggctgttgaattttgtcaaagaccttttctgcatctattgagataatcatgtggtttttctcattggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatattcatcaaggatattggtctaaaattctctgttttggttgtgtctctgcctggcttttgtatcaggatgatgctggcctcataaaatgagttaggaaggattccctctttttctattgattggaatagtttcagaaggaatggtgccagttcctccttgtacctctggtagaattcagttgtgaatccatctggtcctggactctttttggttgataagctattgattattgccacaatttcagagcctgttattcgtctattcagagagtcaacttcttcctggtttagtcttgggagggtgtatgtgtcgaggaatttatccatttcttctagattttctagtttatttgtgtacaggtgtttgtagtattctctgatggtactttgtatttctgtgggattggtggtgatatcccctttatcattttttattgtgtctatttgattcttctctcttttcttctttattagtcttgctagaggtctatcaattttgttgatcctttcaaaaaaccagctcctggattcattaattttttgaagggttttttgtgtctctatttccttcagttctgctctgattttagttatttcctgccttctgctagcttttgaatgtgtttgctcttgcttttctagttcttttaattctgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttctttatgtacccagtagtcattcaggagcaggttgttcagtttccatgtagttgtgcagttttgagtgagtttcttaatcctgagttctagtttgattgcactgtggtctgagagacagtttgttataatttctgatcttttacatttgctgaggagagctttacttccaaatatgtggtcaattttggaataggtgtgatgtggtgctgaaaaaaatgtatattctgttgatttggggtggagagttctgtagatgtctattaggtccgcttggtgcagagctgagttcaattcctggatatccttgttaacttcctgtctcgttgatctgtctaatgttgacagttgggtgttaaagtctcccattattattgtgtgggagtctaagtctctttgtaggtcactcaggacttgctttatgaatctgggtgctcctgtattgagtgcatatatatttaggatagttagctcttcttgttgaattgatccctttaccattatgtaatggccttctttgtctcttttgatctttgttggtttaaagtctgttttatcagagaccaggattgcaacccctgccttttttgttttccatttgcttggtagatcttcctccatccttttattttgagcctatgtgtgtctctgcatgtgagatggatttcctgaatacagcacactgatgggtcttgactctttatccaatttgccagtctgtgtcttttaatttgagcatttagtccatttacatttaaagttagtattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacaaaatctctcagcatttgcttgtctgtaaaggattttatttctcctccacttatgaagcttagtttggctggatatgaaattctgggttgaaaattcttttctttaagaatgttgtatattggcccccactctctgctggcttgtagggtttctgccaagagatccgctgttaatctgatgggcttccctttgtgggtaacccaacctttctctctggctgccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctacagagtgttttccaacttggttccattctccctgtcactttcaggtacaccaatcagacgtagatttggtcttttcacatagtcccatatttcttggaggctttgttcgtttctttttattcttttttctctaaacttcccttctcgcttcatttcattcatttcatcttccgtcactgatagcctttcttccagttgatcgcattggctcctgaggcttctgcattcttcacgtagttctcgagccttggctttcagctccatcagctcctccaagcacttctctgtattggttattctagttatacattcgtctaattttttttcaaagttttcaacttctttgcctttggtttgaatttcctcctgtagcttggagtagtttgatcgtctgaagccttcttctctcaactcatcaaagtcattctccgtccagctttgttcctttgctggttaggagttgggttcctttggaggaggagaggagctctgctttttagagtttccagtttttcttctctgttttttccccatctttgtggttttatctacttttggtctttgatgatggtgatgtacagatgggtttttggtgtggatgtcctttctgtttgttagttttccttctaacagacacgaccctcagctgcatgtctgttggagtttgctagaggtccactccataccctgtttgcctggttt

SEQ ID NO: 12487 - DNA, 7799 bp, Homo sapiens
cccattaactggtcatttacactaggtatatctcctaatgctatcccttctccctccccccaccccacaacaggccccaatgtgtgatgtcccccttcctgtgtgcttgtgttctcattgttcaattcccacctatgagtgagaatatgcgatgtttggttttttgtccttgcgatagtttgctgagaatgatggtttccagcttcatccatgtccctacaaaggacatgaactcatcattttttatggctgcctagtattccatggcatatatatgccacattttcttaatccagtctgcattgttggacatttgggttggttccaggtctttgctattgtgaatagtgctgcaataaacatacgtgtgcatgtgtctttacaacagcatgatttataatcccttgggtatatacccagtaatgggatggctgggtcaaatggtatttctagttctagatccctgaggaatcgccacactgtcttccacgatggttgaaccagtttacagtcccaccaacagtgtaaaagtgttcctatttctccacatcctcttcagcacctgttgtttcctgacttttttttttttattgtactttaagttttagggtacatgtgcacaatgtgcaggttagttacatatgtatacatgtaccatgctggtgtgctgcacccactaactcaccatctagcattaggtatatctcccaatgctatccctcccccttccccccaccccacaacagaccccagagtgtgatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatggcatggctgggtcaaatggtatttctagttctagatccctgaggaatagccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtgcttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagttgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtataaggaagggatccagtttcagctttctacatatggctagccagttttcccagcaccatttattaaatagggaatcctttccccatttcttgtttttctcaggtttgtcaaagatcagatagttgtagatatgcggtgttatttttgagggctctgttctgttccattgatctatatctctgttttggtaccagtaccatgctgttttggttactgtagccttgtagtatagtttgaagtcaggtagtgtgatgcctccaactttgttcttttggcttaagattgacttggcgatgcgggctcttttttggttccatatgaactttaaagtagttttttccaattctgtgaagaaagtctttggtagctttatggggatggcattgaatctgtaaattaccttgggcagtatggccattttcatgatattgattcttcctacccatgagcatggaatgttcttccatttgtttgtatcctcttttatttccttgagcagtgatttgtagttctccctgaagaggtccttcacatcccttgtaaattggattcctaggtgttttattctctttgaagcaattgtgaatgggagttcactcatgatttggctctctgtctgttgttggtgtataagaatgcttgtgatttttgtacattgattttgtatcctgagactttgctgaagttgcttatcagcctaaggagattttgggctgagacaatggggttttctagatatacaatgatgttatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatgttgaaccagccttgcatcccagggatgaagccaccttgatcttggtggataagctttttgatgtgctgctggattcggtttgccagtattttattgaggatttttgcatcaatgttcatcaaggatattggtctgaaattctcttttttggttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactcattttggttggtaagctattgattattgccacaatttcagagcctgttattggtctattcagagattcaacttcttcctggtttagtcttgggagagtgtatgtgtcgaggaatttatccatttcttctagattttctagtttatttgcgtagaggtatttgtagtattctgtcatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattagttttttgaaggtttttttgtgtctctatctccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattttcctctacacactgctttgaatgcatcccagagattctggtatgttgtgtctttgttctcattggtttcaaagaacatctttatttttgccttcatttcgttatgtacccagtagtcattcatgagcaggttgttcagtttccatgtagttgagcagttttgagtgagtttcttaatcctgagttctagtttgattgcactgtggtctgagagatagtttgttataatttctgttctttcacatttgctgaggggaactttacttccaagtatgtggtcaattttggtataggtgtgatgtggtgctgaaaaaaatgtatattctgttgatttggggtggagatttctctagatgtctattaggtcctcttggtgcagagctgagttcaattcctgggtatccttgttgactttctctcttgttgatctgtctaatgttgacagtggggtgttaaagtctcccattattaatgtgtgggagtctaagcctctttgtaggtcactcaggacttgctttatgaatctgggtgctcctgtattgggtgcatatatatttaggatagttagctcttcttgttgaattgttccctttaccattatgtaatggccttctttgtctcttttgatctttgttggtttaaagtctgttttatcagagactaggattgcaacccctgccttttttttgttttccatttgcttggcagatcttcctccatgcttttattttgagcctatgtgtgtctctgcacatgagatgggtttcctgaatacagcacactgatgggtcttgactctttatccaatttgccagtctgtgtcttttaattggagcatttagtccatttacatttaaaattaatattgttatgtgtgaatttgatcctgtcattatgatgttagctgggtattttgctcgttagttgatgcagtttcttcctagtctcgatggtctttacattttggcatgattttgcagcagctggtaccggttgttcctttccatgtttagcacttccttcaggagctcttttagggcaggcctggtggtgacaaaatctctcagcatttgcttgtctgtaaagtattttatttctccttcaattatgaagcttagtttggctggatatgaaattctgggttgaaaattcttttctttaagaatgttgaatattggccccaactctcttctggcttgtagagtttctgccaagagatttgctgttagtctgatgggcttccctttgaggttaacccgacctttctctctggctgcccttaacattttttccttcatttcaactttggtgaatctgacaattatgtgtcttggagttcctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcgcttcatttcattcatttcatcttccatcgctgataccctttcttccagttgatcgcatcaggtcctgaagcttctgcattcttcacgtagttcttgagccttggttttcagctccatcagctcctttaagcacttctctgtattggttattctagttatacattcttccaaatttttttcaaagttttcaacttctttgcctttggtttgaatgtcctcccatagctcggagtgatttgatcatctgaagccttcctcactgagctcgtcaaagtcattctccgtccagctttgttccgttgctggtgaggaactgcgttcctttggaggaggagaggcactctgctttttagagtttccagtttttctgctctgttttttccccatctttgtggttttatctacttttggtctttgatgatggtgatgtgcacatgggtttttggtgtggatgtcctttctgtttttcagttttccttctaacagacaggaccctcagttgcaggtctgttggagtacctggccgtgtgaggtgtcagtgtgcccctgctggggggtgcctcccagttaggctgctcgggggtcaggggtcagggacccacttgaggaggcagtctgcccgttctcagatctccagctgcatgctgggagaaccacttctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaggcaagcctgggcaatggtgggcgcccctcccccagcctcgctgccaccttgcagtttgatctgagactgctgtgctagcaatcagcaaagactccgtgggcgtaggaccctccgagccacgtgcgggatataatctcctggtgcgccgtttttttaagcccgtcagaaaagcgcagtattcgggtggaagtgacccgattttccagttgccgtctgtcactgctttctttgactagcaaagggaactccctgaccccttgtgcttcccgagtgaggcaatgccttgccctgcttcagctcatgcacggtgcgcacatccactgacctgcgcccactgtctggcactccctagtgagatgaacccggcacctcagatggaaagcagaaatcacccatcttctgtgtcgctcatgctgggagctgtagactggaactgttcctattcggccatcttggctcctgtttcctgactttttaatgatcgccattctaactggtgtgagatggtatctcattgtggttttgatttgcatttctctgacggccagtgatgatgagcattttttcatgtgtctgttggctgcataaatgtctgcttttgagaagtgtctgttcatgtcctttgcccacttgttgatggggttgtttttttcttgtaaatgtgttgagttctttgtagattctggatattagccctttgtcagatgagtaggttgcaaacattttctcccattctgtaggttgcgtgttcactctgatggtagtttcttttgctgtacagaagctctttagtttaattagatcccatttgtgaattttggcttttgttgccattgcttttggtgttttagacatgaagtccttgcccatgcatatgccctgaatggtattgcctaggttttcttctagggtttttatggttttaggtctaacatttaagtctttaatccatcttgaattaatttttgtataaggcataaggaagggatccagtttcagcttcctatatatggctagccagttttcccagcaccatttcttaaatagggaatcctttccccatttcttgtttttgtcaggtttgtcaaagatcagatagttgtagatgtgtggtattatttctgagggctccgttctgttccattggtctatatcaatgttttggtaccagtatcatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctatgaagaatgtcattggtagcttgatgggaatggcattgaatctataaattaccttgggcagtatggccattttcacgatattgattcttcctatccatgagcatggaatgttcttccatttgtttgtgtcctcttttatttcatcgagcagcggtttgtagttctccttgaagaggtccttcacatcccttgtaagttggattcctaggtattttattctctttgaagcaattgtgaatgggagttcactcatgatttggctctctgtttgtctgctattggtgtataagaatgcttgtgatttttgcatattgattttgtatccttaatac

SEQ ID NO: 12488 - DNA, 10014 bp, Homo sapiens
tattttttttaaattttattattattatactttaagttttagggtacatgtgcacaaggtgcaggtttgttacatatgtatacatgtgcaatgctggtttgctgcacccattaactcgtcatttagcattaggtatatctcctaatgctatccctccccctcccccaccccaaaacaatccccagtgtgtgatgttccccttcctgtgtccatgtgctctcatcgttcaattcccacctatgagtgagaacatgtggcgtttggtttcttgtccttgcgatagtttgctgagaatgatggtttccagtttcatccatgtccctaaaaaggacatgaacttatcattttttttttattatactttaagttttagggtacatttgcacattgtgcaggttagttacatatgtatacatgtgccatgctggtgcgctgcacccactaactcatcatctagcattaggtatatctcccgatgctatccctcccccttcccaccaccccataacagtccccagagtgtgatattccccttcctgtgtccatgtgatctcattgttcagttcccacctatgagtgagaatatgtggtgtttggttttttgttcttgtgatagtttactgagaatgatgatttacaatttcatccatgtccctacaaaggacatgaactcatcattttttatggctgcatagtattccatggtgtatatgtgccacattttcttgatccagtctatcattgttggacatttgggttggttccaagtctttgctattgtgaataatgccgcaataaacatacgtgtgcatgtgtctttatagcagcttgatttatagtcctttgggtatatacccagtaatgggatggctgggtcaaatggtgtttccagttctagatccctgaggagtcgccacactgacttccacaagggttgaactagtttacagtcccaccaacagtgtaaaagtgttcctatttctccacatcctctccagcacctgttgtttcctgactttttaatgattgccgttctaactggtgtgagatggtatctcattgtggttttgatttgcatttctctgatgaacagtgatgatgagcattttttcatgtgttttttggctgcataaatgtcttcttttgagaagtgtctgttcatgtccttcacccactttttgatgagtttttttttttttcttgtaaattagtttgagttcattgtagattctagatattagccctttgtcagatgagtaggttgcaaaaattttctcccattttttaggttgcctgttcactctgatggtagtttcttttactatgcagaagctctttagtttaattagatcccatttgttaattttggcttttgttgccattgcttttggtgttttagacatgaagtccttgcccatgcctatgtcctgaatggtaatgcctagggtttcttctagggtttttatggttttaggtctaacgtttaagtctttaatcaatcttgaattgatttttgtataaggtgtaaggaagggatccagtttcagctttctacatatggctagccacttttcccagcaccatttattaaatagggaatcctttccccattgcttgtttttctcaggtttgccaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgctcttttcgtttaggattgacttggcgatgcgggctcttttgtggttccatatgaacttgaaagtagttttttccaattctgtgaagaaagtcattggtagcttgatggggatggcattgaatctgtaaattaccttgggcagtatggccattttcacgatattgattcttcttacccatgagcatggaatattcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgtctgtgtataagaatgcttgtgatttttgtacattgattttgtatcctgagtctttgctgaagttgcttatcagcttaaggagattttgggatgagacaatggggttttctagatatacaatcatgttgtctgcaaacagggacaatttgacttcctcttttcctaattgaataccctttatttccttctccagcctgattgccctggccagaacttccaacactatgttgaataggagtggtgagagagggcatccctgtcttgtgccagttttcaaagggaatgcttccagtttttgcccattcagtatgatattggctgtgggtttgtcacagatagctcttattattttgaaatacgtcccatcaatacctaatttattgagagtttttatcatgaagggttgttgaattttgtcaaaggctttttctgcatctattgagatattcatgtggtttttgtctttggctctgtttatatgctggattacgtttattgatttgcgtatattgaaccagccttgcatcccagggatgaagcccacttgatcatggtggataatctttttgatgtgctgctggatttgttttgccagtattttattgaggatttttgcatcaatgttcatcaaggatattcgcataaaattatctttttttgttgtgtctctgcctggctttggtatcaggatgatactggcctcataaaatgagttagggaggattccctctttttctattgattggaatagtttcagaaggaatggtagcagctcctccttgtacctctggtagaattcggctgtgaatccatctggtcctggactctttttgattggtaagctattgattattgccacaatttcagatcctgttattggtctattcagagattcaacttcttcctggtttagtcttggaaaagtgtatgtgtccaggaatttatccatttcttctagattttctagtttatttgcgtagaggtgtttgtagtattccctgatggtagtttgtatttctgtgggatcggtggtgatatcccctttatcattttttattgcgtctatttgattcttctctctttttttctttattagtcttgctagcagtctatcaattttgttgaccctttcaaaaaaccagctcctggattcattgattttttgaagggtttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtcattgttctccttggtttcaaagaacatctttatttctgccttcctttcgttatgtacccagtagtcactcaggagcaggttgttcagtttccatgtagttgagcggttttgagtgagtttcttaatcctgagttctagtttgattgcactgtggtctgagagatagtttattataatttctgttcttttacatttgctgaggagagctttacttcccagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgaatttctgtctcgttgatctgtctaatgttgacaatggggtgttaaagtctcccattattaatgtgtgggagtctaagtctctttatagttcactcaggacttgttttatgaatcttggtgctcctgtattgggtgcatatatatttaggacagttagctcttcttgttgaattgatccctttaccattatgtaatggccttctttgtctcttttgatctttgttggtttaaagtctgttttatcagagactaggattgcaacccctgcctttttttgtttttcatttgcttggtagatcttcctccatccttttattttgagcttatgtgtgtctctgcccgtgagatgggtttcctgaatagagcacactgacgggtcttgactctttatccaatttgccagtctgtgtcttttaattggagcatttagtccattgacatttaaagttaatattgttatgtgtgaatttgatcctctcattatgatgttagctggttattttgctagttagttgatgcagtttcttcctagtctcgatggtctttacattttggcatgattttgcagcggctggtaccggttgttcctttccatgtttaatgcttccttcaggagctcttgtaaggcaggcctggtggtgagaaaatctctcagcatttgcttgtctgtaaagtattttatttctccttcacttatgaagcttagtttggctgtatacgaaattctggtttgaaaattcttatctttaagaatgttgaatattggcccccactctcttctggcttgtagggtttctgctgagagatccactgttagtctgatgggcttccctttgagggtaacccgacctttctctctgactgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctgaataatatcctgcagagtgttttccaacttggttacatcctccccatcactttcaggcacaccaatgagacgtagatttggtcttttcacatagtcccatatttcttggaggctttgctgatttctttttattcttttttctctaaacttcccttctcgcttcatttcattcatttcatcttccatcactgatgccctttcttccagttgatcgcattggctcctgaggcttctgcattcttcacgtagttctcgagccttggttttcagctccatcagctcctttcagcacttctctgtattggttattctagttatacattcttctaaattttttttcaaagttttcaacttctttgcctttggtttgaatgtcctcccgtagctcagagtaatttgatcgtctgaaggcttcttctctcagctcgtcaaagtcattgtccgtccagctttgttccgttgcttgtgaggaactgcgttcctttggaggaggagaggtgctctgctttttagagtttccggtttttctgttctgttttttccccatctttgtggttttatctatttttgttctttgatgatggtgatgtacagatgggtttttggtgtggatgtcctttctgtttgttagttttccttctaacagagaggaccctcagttgcaggtctgttggagtaccctccgtgtgtggtgtcagtgtgcccctgctggggggtgactcccagttaggctgctcaggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcagacaggcctccttgagctgtgttgggctccacccagttcgaggttccaggctgccttgtttacctaatcaagcctgggcaatggtgggcgcccctcccccagcctcgctgccaccttgtagtttgatctcagactgctgtgctagcaatcagcaagactccttgggcgtaggaacctccgagccaggtgcgggatataatctcgtggtgcgccgttttttaagcctatcagaaaagcacagtattcgggtgggagtgacccgattttccaggtgccgtccatcaccaatttctttgactcagaaagggaactccctgaccccttgcgcttccctggtgagacaatgccttgccctgcttcgtctcacgcatggtgcgcacacccactgacctgcgtccactgtctggcactccctagtgagatgaacccggtacctcagatggaaatgcagaaatcacccgtcttcttcgtcgctcatgctgggagctgtagactggagctgttcctattcggccatcttggctcctccccccgaaatccgaactcatcattttttatggctgcatagtattccatggtgtatatgtgccacattttcttaatccagtttttcgttgttggacatttaggttggttccaagtctttgctattgtgaatagtgccgcaataaacatacgtttgcacgtgtctttataccagcatgatttaaaatcctttgggtatatacccagtaatgggatggctgggtcaaatggtatttctaattctagatccctgaggaatcgccacactgacttccacaatggttgaactagtttacagtcccaccaacagtgtaaaagtcttcctatttctccacatcctctctagcacctgttgtttcctgactttttaatgatcaccattcgaactggtgtgagattatatctcattgtggttttgatttgcatttctctgatggccagtgatgatgagcatttcttcatgtctttttcggctgcataaatgtcttcttttcagaagtgcctgttcatatactttgtccactttttgatggggttgtttgtttttttcttataaatttgtttgagttcattgtagattctggatattagccctttgtcagatgagtaggttgcaaaaattttctcccattttgtaggttgcctgttcactctgatggtagtttcttttgttgtgcagaagctcttgagtttaattagatcccatttgtcaattttggcttttgttgccattgcttttggtgtttcagacatgaagcacttgcacatgcttatgtcctgaatggtattgcctaggtttgttctagggttttcatggttttaggtctaacatttaagtctttaactcatcgtgccttaatttttgtataaggtataaggaagtgatccagtttcagctttctacatatgtctagccagttttcccagcaccatttattaaatagggaatcctttccccattgcttgtttttctcaggtttgtcaaagatcagatagttgtagatatgcagcattatttctgagggctccgttctgttccattggtctatatctctgttttggtaccagtaccatgctgttttggttactatagccttgtagtatagtttgaagtcaggtagcgtgatgtctccagctttgttcttttggcttaggattgacttggtgatgcgggctttttttggtgccatatgaacttgaaagtagttttttgcaattctgtgaagaaagtcattggtagctagatggggatagtattaaatctataaattaccttgggcagtatggcctttttcacgatattgattcttcctacccatgaacatggaatgtccttccatttgtttgtatcctcttttatttcattgtgcagtggtttgtagttctccttgaagaggtccttcacatcccttgtaagttggattcctaggtattttatttttttgaagcaattgtgaatgggtgttcactcatgatttggctctctgtttgtctgttattggtgtataagaatgcttgtgatttttgtacattgattttgtatgctgagactttgctgaagttggttaccagcttgagaagattttgggctgagatgatggggttttctagatatacaatcatgtcacctgcaaacagggacaatttgacttcctcttttcctaattgaataccttttatttccttctcctgcctgattgccctggccagaacttccaacactatgttgaataggagtcgtgagagagggcatccctgtcttgtgcccgttttcaaagggaatgcttccagtttttgtccattcagtatgatattggttttgggtttttcatagatagctcttattattttgagatacgtcccattgatacttaatttattgagagattttatcatgaggggttgttgaattttgtcaaaggccttttctgcatctattgagacaatcatgtggtttttgtctttggttctctttataggctggattacatttattgatttacatatgttgaatcagccttgcatcccagggatgaagcccacttgattatggtggataagcattttgaagtgctgctggatttggtttgcctttattttattgaggatttttgcattgatgttcatcaaggatattggtctaaaattctcttttttggttgtgtctctgccaggctttggtatcaggatgatgctgtcctcagaaaatgagttaaggaggattccctctgtttctatcaatcagaatagtctcagaaggaatggtaccagctcctctttgtacctctggtagaattcggctgtgaatccatctggtcctggactttttttggttggtaagctgttgattattgcctcaatttcagagcctgttattggtctattcagagactcaacttcttcctggtttagtcttgggtggatgtatgtgtccaggaatttatgcatttcttctagattttctaatttatttgcatagaggtgtttatagtattctctgatggtagattgtatttctgtggtgatatgccctttatcaatttttaatgcgtctatttgagtcttctctcttttcttctttattaatcttgctagtggtctgtcaattttgttgatcttttcagaaaactagctcctggattcattgattttttgaaggattttttgtgtctctatttccttcagttctgctctgatcttagttatttcttgccttctgctagcttttgaatgtgtttgctcttgcttttctagttattttaattgtgatgttagggtgtcaattttagatctttcctcctttctcttgtgggcatttattgctataaatttccctctacacactgctttgaatgtgtcccagagattctggtatgttgtgtctttgttctccttggtttcaaagaacatctttatttctgccttcatttcattatgtacctggaagtcattcaggagcacgttgttcagtttccatttagttgagcagttttgaatgagttccttaatcctgagttctagtttggtagcaatgtggtctgagagacagtttgttataatttctgttcttttacattaactgaggagtgctttacttccaactatgtgtgcaattttggagtaggtgtggtgtggtgatgaaaagaatgtatattctgttgatttggggtggagagttctgtagatgtctattaggtctgcttggtgcagagctgagttcaattcctgggtatccttcttaactttctgtatcgttgatctgtctaatgttgacaatggggtgttaaagtctcccattattattgtgtgggagtctaagtctctttgtaggtcactcaggacttgctttatgaatctgggtgctcctgtattgggtgcatatatatttagggtagttagctcttcttgttgaattgatccctttaccattatgtaatggccttgtctcttttgatctttgttggtttaaagtctgttttatcagaaactaggattgcaacccctgcctttttttgttttccatttgctttgtagatcttcctccatccctttattttgagcctatgtgtggctctgcacatgagatgggtttcctgaatacaacccactgatggttcttgactctatccaacttgccagtctttgtcttt

SEQ ID NO: 12489 - DNA, 9781 bp, Homo sapiens
tttatttatttatttattattattatgctttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccccacaacatgctgctataaagacacatgcacacgtatgtttattgcggcactatttacaataacagagacttggaaccaacccaaatgtccaacaatgatagactggattaagaaaatctggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctgagaactgcatttcttgcagccacaactccaacatgcccatagcactcatgatcagccttgaatatgtaagacagtgttgcagtgtcctggccttgctggtggcagctgtgggcatggtcctctctaaactgaatcttttgttccacattatggtcatgttattccagaacctagatccttttttttttttttgagagggagtctcgttctgtctcccaggctggcggcagtagcgtgatcttggctcactgcaacctccacttcccggtttcaagcaattctcatgtctcagcctctcaagtaactgggactacagctgcacgccaccacgcctagataatttttgtatttttagtagagatagggtttcaccatattggtcaggctggtcccgaactcctaacctcaggtgatccacccacctcagcttcccaaagtgctgggattacaggcatgagtaactgcacccagccagatccgtttttaaaactatcttccttagtgcttcttttttattggattcaaatgccagtagctagaagctactaatttattgaggctttaccctgatactgtttacaatgcatcttttcaggcatatatcatatttgtggatcagacattgacaattacaaggcactgaaatgattatattcaattgccacaattgaagcccttgaaataggatacctgagataatgcattccacattcgtgtctcatttgatgatcaatgtattaatcagaatcagagatgatagcatattatatacttgtcaaaataaacttattagaaatatattagttctaactaaaatcttgcattgatttatcatttgttttattaatagtaagcattacacctgctctcaaatcttctaattaaaagaaatctgtttcctagacagattgaagttaaatggttagcataattcctgtgtgtgtgtggagagaaaagatagtagctcactggcatactccattggcatgccttactttcaggaaaacagagaagaacagctacaggaagcaattgatatccctacacaggttggggttgatatgcaaatttataaacacaatgtttccattctgggtaagctatacagaatcacaccagcaggggtttgatactgtattttcttctgttttagctgtgttgtcatttcagaagctgtgaaactaagaatctctaaaagatgtgttaagagattcaaaaccccagcagagaactatgtaacaataagcaatcatacaaaaagtaaacaataaaacattcaacaatacaaggagggttttacaaaatggatttacaaatttggggtagtatcagtttaatatgacttttgttactccttattgttaacatagtgcttaaggaacttttaaaggtagtgtacaaattggattagtccagagctagttagggaatagtttattattattattattattattttttattttttatttttgagacagttttgctcttgtcacccaggctggagtgcagtggtgcaatctcagctcactgtaacctctgcctcccgggttcaagagattatcctgcctcagcctcccaagtcgttgggattacaggtgcctgccaccatggccagctaattttttgtatttttagtagagatggggtttcaccgtgttggccacgttgctctcaaactcctgacctctggtgatctgcccgccttggcctcccaaagtgttaggattataggcgtgagccaccgctcctggccgggaatagtttttgtctttaattaagctctgttttacttctatataggcataactcagagatatcacaggtttggttccagaccaccacaataaagcaaatatcatagtaaaacaagtcacacatttgttttttggtttctaaatgcacataaaggttacactataccatatatactcatattaagtttacactataccgtatatagtctattacactatgccatacatactctataagtttacactataccgtatatactctattaagtttatactataccatatatactctattaagtgtgcaatagcattatggcttaaaaaacttgcataatttaaaaatactttgttgctaaaaattgccagcaatcatctgagacttcagtgagtcataatctttctgctggtggagagtcttgtctggatgtggatggctgctgactggttaggttggtggttgctgaaggttgaggtggctgtggcaatttgttaaggcaacactgaaggttgccacattggttgacacttcctttcacgaacgatttctctgtagcattcaatgctgtctgatagcattttactcacatagaacttctttcaaaattggtgtcaatcctctcaaaccccggcactgcttaatcaactaggtttatttaatattttaaattcctctttgtcattcaacattgttcatagcaccttcatcaggaaaagattccatctccagagactgctttctttgttcatccataagaagcaacttcttatgcgttcaagttttattgtgagattacagcaattgtcacatcttcagactccacttcttttttttttttttgaaacggagtctcgctctgtcgcccaggctggagtacagtggcaccatttcggctcactgcaagctccgcctcctgggttcatgcccttctcctgcctcagcctccacgcccccgccaccacgcctggctaattttttttttttgtattttttgtagagatggggtatcaccgtgttagccaggatggtctcgatctcccgaccttgtcatccgcccgccttggtctcccaaagtgctgggattacaggcgtgagctaccgcgcccagcccagactccacttctaactctagttctcttgttatttttaccacatctgtgattctttcctcccctgaagcctagaacccctcaaagtcacccattaggtttggaatcaacttcttccaaactcctgttaatggtgatatttgacttccttccattaatcatgattcttttttttttttttttttttttttttttagagacagggtctcactctgttgcccaggttggaatgcagttgcatgattatggctcactgcagccagccttgaaatcccgggctcagtcgatcctcccacctcagccttccaagtcactgggactacaggcacatgccaccatacccagttagtttttttttcttttttttttttttttttttttattttttttttatttttttttttttttattatactctcagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagactatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggtttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggtttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaagtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctagtcagagattcagcttcttcctggtttagtcttgggagagtgtatgtgttgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcctatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctagtgaggaactgcgttcctttggaggaggagaggtgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtacgtccgtcacccctttctttgactcggaaagggaactccctgaccccttgcgcttcccaggtgaggcaatgcctcgccctgcttcggcttgcgcacggtgcgcacacacactgacctgcgcccactgtctggcactccctattgagatgaacccggtacctcagatggaaatgcagaaatcacccgtcttctgcgtcgctcacgctgggagctgtagaccggagctgttcctattcggccatcttggctcc

SEQ ID NO: 12490 - DNA, 9701 bp, Homo sapiens
cctaactgggaggcaccccccagtaggggcagactgacacctcacacggcccagtactcctctgagtcaaaacttccagaggaacgatcagacagcagcattcacggttcatgaaaatctgctgttctgcagacaccactgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagttcctcaccagcaacggaacaaagctggacggagaatgactttgacgagttgagagaagaaggcttcagataatcaaactactccgagctacaggaggaaattcaaaccaaaggcaaagaagttgaaaactttgaaaaaaatctagacgaatgtataactagaataaccaatacagagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaatgaacaaagcctccaagaaatatgggactatgtgaaaaggccaaatctatgtctgattggtgtacctgaaagtgacagggagaatggaaccaagttggaaaacactctgcgggatattatccaggagaacttccccaatctagcaaggcaggtcaatgttcagattcaggaaatacagagaacaccacaaagatactcctcgagaagagcaactccaagacacataattgtcagattcaccaaagttgaaatgaaggaaaaaatgttaagggcagccagagagaaaggtcgagttacccacaaagggaagcccatcagacaaacagcagatctctcagcagaaactctacaagccagaagacagtgggggccaatattcaacattctttttttttattattatactttaagttttagggtacatgtgcacattgtgcaggttagttacatatgtatacatgtgccatgctggtgcgctgcacccactaactcatcatctagccttaggtatatctcccaatgctatccctccccactccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaacttcatccatgtccctacaaaggacatgaactcatcattttttatcgctgcatagtattccatggtgtttatgtgccacattttcttaatccaatctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggatctgttctgttccattgatctatatctctgttttggtaccagtaccatgctgttttggttactgtagctttgcagtatagtttgaagtcaggtagtgtgatgcctccagcacacttcttttggcttaggattgacttggcgatgcgggctcttttttgcttccatatgaactttaaagtagttttttccaattctgtgaataaagtcattggtagcttgatggagatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagtaggattcctaggtattttattctctttgaagcaattgtgaatgggagttcactcatgatttggctctctgtttgtctgttgttggtgtataagaatgcttgtgatttttgtacattgattttgtatcctgagactttgctgaaggtgcttattagcttaaggagattttgggctgagacaatggggttttctagataaacaatcatgtcgtctgcaaacagggacaatgtgacttcctctcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagctttccatcccagggatgaagcccacttgatcatggtggataagctttttgatgtgctgctggattcggtttgccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgttaatccatctggtcctggattctttttggttggtaaactattgataattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatccttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgatcttttacatttgctgaggagtgctttacttccaactatgtggtcaattttggaataggtgtggtgtggtgctgaaaaacatgtatattctgttgatttggggtggagagttctgtagatgtctattaggtccgcttggtgcagagctgagttcaattcctgggtatccttgtggactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggtagatcttcctccatccttttattttgagcctatgtgtgtctctgcatgtgagatgggtttcctgaatacagcacactggtgggtcttgactctttatccaacttgccagtctgtgtcttttaattggagaatttagtccatttacatttaaagttaatattgttatgtgtgaatttgatcctgtcattatgatgttacctggtgattttgctcgttagttgatgcagtatcttcctagtctcgatggtctttacaatttggcatgattttgccgcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgcttttagtctgatgggcttccctttgagggtaacccgacctttctctctggctgcccttaacattttttccttcatttcaactttggtgaatgtgacaattatgtgtcttggagttgctcttctcgaggagtatctttgtggtgttctctgtatttcctgaatctgaacattggcctgccttgctagattggggaagttctcctggataatatcctgcagagtgttttccaacttggttccattctccgcatcactttcaggtacaccaatcagatgtagatttggtcttttcacatagtcccatatttcttggaggctttgctcatttctttttattcttttttctctaaacttcccttcttgcttcatttcattcatttcgtcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcgtttggtttgaatgtcctcccgtagctcagagtaatttgatcgtctgaagccttcttctctcagctcatcaaagtcattctccatccagctttgttccgttgctggtgaggaactgcgttcctttggaggaggagaggcaccctgcgttttagagtttccagtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccatgtgaggtgtcagtgtgcccctgctggggggtgcctcccagttaggctgctcgggggtcagggatcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgctgccgccttgcagtttgatctcagactgctgtgctagcaatcagcgagattccatgggcgtaggaccctccaagccaggtgtgggatatagtctcgtggtgcgccgttttttaagccggtctgaaaagtgcaatattcgggtgggagtgacccgattttccaggtgcgtccgtcacccctttctttgactcagaaagggaactccctgaccccttgcgcttcccaggtgaggcaatgcctcaccctgctttggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccagagcttttcctattcggccatcttggctcctcccaacattcttaaagaaaagaattttcaacccagaatttcatatccagccaaactaagcttcataagtgaaggagaaataaaataccttacagacaagcaaatgctgagagattttgtcaccaccaggcctgccctaaaagagctcctgaaggaagcactaaacatggaaaggaacaactggtaccagctgctgcaaaaccatgccaaattgtaaagaccattgaggctaggaagaaactgcatcaactaacgagcaaaataaccaggtaacatcataatgacaggatcaaattcacacataagaatattaacttaaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacacactttaaaccaacaaagatcaaaagagacaaagaaggccattacataatggtaaagggatcaattcaacaagaagagctaactatcctaaatatatatgcacccaatacaggagcactcagattcataaagcaagtcctgagtgacctacaaagagacctagactcccacacaataataatgggagactttaacaccccactgtcaacattagacagatcaacaagacagaaagtccacaaggatacccaggaattgaactcagctctgcaccaagcggacctaatagacatctacagaactctccaccccaaatcaacagaatatacatgtttttcagcaccacaccacacctattccaaaattgaccacatagttggaagtaaagcactcctcagcaaatgtaaaagatcagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaggatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagatgaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacaccctcccaagactaaaccaggaagaagttgaatctctgaatagaccaataacaggctctgaaattgtgtcaataatcaatagcttaccaaccaaaaagagtccaggaccagatggattcacagccgaattctaccagaggtataaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgacgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatattgaatgggcaaaaactggaagcattccctttgaaaactggcacaagacagggatgccctctctcaccgctcctattcaacatagtgttggaagttctggccagggcaattacgcgggagaaggaaataaagggtattcaattaggaaaagaggaagtcaaattgtccctgtttgcagatgacatgattgtatatctacaaaaccccattgtctcagcccaaaatctccttaagctgataagcaccttcagcaaagtctcaggatacaaaatcaatgtacaaaaatcacaagcattcttatacaccaataacagacaaacagagagccaaatcatgagtgaagttgttc

SEQ ID NO: 12491 - DNA, 6058 bp, Homo sapiens
ttttttttttttttaagattttattattattattttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccacaacagtccccagagtgtgatattccccttcctgtgtccatgtgatctcattgttcaattctcacctatgagtgagaatatgcggtgtttggttttttgttcttgcgatagtttactgagaatgatgatttccaatttcatccatgtccctacaaaggacatgaactcatcattttttacggctgcatagtattccatggtgtatatgtgccacattttcttaatccagtctatcattgttggacatttgggttggttccaagtctttgctattgtgaataatgccgcaataaacatacgtgtgtatgtgtctttatagcagcatgatttatagtcctttgggtatataccgagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctgactggtgtgagatggtatctcattgtggttttgatttgcatttctctgatggccagtgatgatgagcattttttcatgtgttttttggctgcataaatgtcttctcttgagaagtgtctgttcatgtccttcgcccactttttgatgggattgtttgtttttttcttgtaaatttgtttgagttcattgtagattctggatatcagtcctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagcgagttttcccagcaccatttattaaatagggaaccctttccccattgcttgtttttctcaggtttgtcaaagatcagatagttgtagatatgcggcgttatttctgagggctctgttctgttccattgatctatatctctgttttggtaccagtaccatgctgttttgggtactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtcattggtagcttgatggggatggcattgaatctgtaaattaccttgggcagtatggccattttcacgatattgattcttcctacccatgagcatggcatgttcttccatttgtatgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactaagttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggttgaagcccacttgatcatggtggataagctttttgatgtgctgctggattcgttttgccagtattttattgaggatttttgcatcaatgttcatcaagtatattggtctaaaattctcttttttggttgtgtctctgcctggctttggtatcagaatgatgctggccttataaaatgagttagggaggattccctctttttctattgattggaatagtttcagaaggaatggtaccggttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatatatccatttcttctagattttctagtttatttgcgtagaggtgtttgtagtattctctgatggtagtttgtatttctgtgggatctgtgatgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctctcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactctgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctctttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtgtaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctgtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattgtccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcgttcctttggaggaggagagacactctgcgttttagagtttccagtttttctgttctgttttttccccatctttgtggttttatgtacttttggtctttgatgatggtgatgtacagatgggttttcggtgtggatgtcctttctgtttgttagttttccttctaacagacaggaccctcagctgcaggtctgttggaataccctgcgatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcctggctgctttgtttacctaagcaagcctgggcaatggcgggcgcccctcccccagcctcactgccgccttgcagtttgatctcagactgctgtgctagcaatcagcgagattccgttggcgtaggaccctctgagccaggtgtgggatataatctcgtggtgcgccgttttttaagccggtctggaaagggcaatattcgggtgggagtgacccgattttccaggtgcgtccgtcaccgctttctttgactgggaaagggaactccctgaccccttgcgcttcccaagtgaggcaatgcctcgccctgcttcggctcgcgcacggtgcgcgcacccactggcctgcacccactgtctggcactccctagtgagatgaacccggtacctcagatggaaatgcagaaatcacccgtcttctgcgtcgctcatgctgggagctgtagaccggagctgttcctattcggccatcttggctcctcctcgc

SEQ ID NO: 12492 - DNA, 4944 bp, Homo sapiens
ttttgttttttttattttttattttttttaaattatactttaagttttagggtatgtgtgcacaacatgcaggtttgttacatatgtatacatgtgccatgttggtgtctgcacccattaactcgtcatttaacattaggtatatctcctaatgctatccctcccccctccccccaccccacaacaggctcctgtgtgtgatgttccccttcctgtgtccatgtgttctgattgttcagttcccacctatgagtgagaacatgtggtgtttggttttttgtccttgcgatagtttgctgagaatgatggtttccagcttcatccatgtccctacaaaggacgtgaactcatccttttttatggctgcatagtattccatggtgtatatatgccacattttcttaatccagtctatcattgttggacatttgggttggttccaagtctttgctattgtgaatagtgccgcgataaacatacgtgtgcatgtgtctttagagcagcatgatttagaatcctttgggtatatacccagtaacgggatggctgggtcaaatggtatttcccattctagatccctgaggaatcgccacactgacatccacaatggttgaactagtttacagtcccaccaacagtgtaaaagtgttcctatttctccacatcctctccagcacctgttgtttcctgactttttaatgatcgccattctaactggtgtgagatggtatctcattgtggtttcaatttgcatttctctgatggccagtgatgatgagcattttttcatgtgtcttttggctgcataaatatcttcttttgagaagtgtctgttcatatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtagttgcttttgctgtgcagaagctctttagtttaattagatcccatttgtcaatattggcttttgttgctgttgcttttggtgctttagatatgaagtccttgcccatgcctatgtcctgaatgatattgcctaggttttcttctagggtttttatggttttaggtctaacatgtaagtctttaatccatcttgaattaatttttgtataaggtgtaaggaagggatccagtttcagctttctacacatggctagccagttttcccagcaccatttattaactagggaatcgtttccccattgcttgtttttgtcaggtttgtcaaagatcacatggttgtagatatgtggcattatttctgagggctctgttctgttcccttgatctatacctctgttctggtaccagtaccatgctattttggttactgtagccttgtagtatactttgaagtcaggtagcatgatgcctccagctttgttcttttggcttaggattgacttggcaatgtgggctcctttttggttccatatgaactttaaagtagttttttccaattctgtgaagaaagtcattggtagcttgatggggatggcattgaatctataaattacattgggcagtatggccattttcatgatattgattcttcctacccatgagcatggaatgttcttccatttgtttgtatcctcttttatttcattgagcagtggtttgtaattctccttgaagaggtccttcacgtcccttgtaagttggattcctaggtattttattctctttgaagcaattgtgaatgggagttcactcatgatttggctctctgtttctctgttattggtgtataagaatgcttgtgatttttgcacattgattttgtatcctgagactttgctgaagttgcctatcagcttaaggagattttgtgctgagacgatggggttttctagatatacaatcatgtcatctgcaaacagggacaatttgacttcctcttttcctacttgaataccctttatttccttctcctgcctgattgccctggccagaacttccaacactatgttgaataggagtggtgaaagagggcatccctgtcttgtgccagttttcaaagggaatgcttccagtttttgcccattcagtatgatattggctgtgggtttgtcatggatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggattaagccgacttgatcatggtggataagctttttgatgtgctgctggattcagtttgccagtattttattgaggatttttgcatcgatgttcatcagggatattggtctaaaattctcttttttggttgtgtctctgccaggctttgggatcaggatgatgctggcctcataaaatgagttagggaggattccctctttttctattgactggagtagtttcagaaggaatggtaccagctcctccttgtacctctggtagaatttggctgtgaatccatctggtcctggactttttttggttggtaagctattaattattgcctcagtttcagagcctgttattggtctattcagagattcaacttcttcctggtttagtcttgggagggtgtatgtgtctaggaatttatccatttcttctagattttccagtttatttgcatagaggtgtttatagtattctctgatggtagtttgtatttctgtgggatcagtggtgatctcccctttatcattttttattgcgtctatttgattcttctctcttttcttctttattagtcttgctagtggtctatcaattttgttgatcttttcaaaaaaccagctcctggattcactgatttttttgaagggttttttggtgtctctatttccttcagttctgctctgatcttagttatttcttgccttctggtagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctctttggtttcaaagaacatctttatttctgccttcatttcgttatgtagtcagtagtcattcaggagcagttgttcagtttccatgtagttgagtggttttgagtgagtttcttaatcctgagttctagtttgattgcactgtggtctgagaggcagtttgttttaatttctgttcttttacatttgctgaggagtgctttacatccagctatgtggtcaattttggaataagtgtggtgtggttctgagaagaatgtacattctgttgatttggggtggagagttctgtagatgtctattaggtctgcttggtgcagagctgagttcaattcctggatatccttgttaactttctgtctcgttgatctatctaatgtttacagtggggtgttaaagtctcccattattattgtgtgggagtctaagtctctttgtaggtctctaagaacttgctttatgaatctgggtgctcatgtactgggtgcatatatatttaggatagttagcttttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctgtgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattctgctcattagttgatgcagtttcttcctagcctcaatggtctttacaatttggcatgtttttgcagtggctggtatcagttgttcctttccatatttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccgctctcttctggcttgtagagtttctgccgagagatcagctgttagtctgttgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagatgggggaagttctcctgtatgatatcctgaagagtgttttccagcttggttccattctccctgtcactttcaggtacaccaatcagacgtagatttggtcttttcatgtagtcccatatttcttggaggctttgttcatttctttttattcttttttctctaaacttctcttttcactgcatttcattcatttgatcttccatcactgatcccctttcttccagttgatcgaatcggctactgaggcttgtgcattcatcacgtagttctcgtgccttggttttcagctccatcaggtcctttaaggacttctctgcatggttattccagttagccattcgtctaattttttttcaaggtttt

SEQ ID NO: 12493 - DNA, 9130 bp, Homo sapiens
ggtgtatatgtgccgcattttcttaatccagcctatcattgatggatatttgggttggttccaagtcgtctttgctattgtgaatagtccgcaataaacatacgtgtgcatgtgtctttatagtaaaatgatttgtaatcctttgggtatatacccagtaatgggattactgggtcaaatggtatttctagttctagatccttgaggaatcaccacactgtcttccacaatggttgaactaatttacacgcccatcaacagtgtaaaagagttcctatttctccacatcctctccagcatctgttgttacctgactttttaatgattgccattctaactggtgtgagatggtatctcattgtggttttgatttgcatttctctgacgacctgtgatgatgagcattttttcatgtgtctgttggctgcataaatgtcttcttttgagatgtgtctgttgatatcctttgcccacttttttgatggggttgtttgattttttcttgtaaatttgtttaagttctttgtggattctggatattagccctttgccaagtgggtagactgcaaaaattttctcccattctgtaggtttcctgttcactctgatgatagtttcttttgctgtgcagaaggtctttagtttaattagattttacttgtctattttggcttttgttgccattgcttttggtgtttcagtcatgaagtctttgaccatgcctatgtcctgaatggtattgcttaggttttcttctagggtttttatggttttaggtcttacatttaggtctttaatccatcttgaattaatttttctataaggtataaggaagggatccagtttcagctttctgcatatggctagccagttttctcaacaccatttattaaatagggaatcctttccccactgcttgtttttgtcaggtttgtcaaagatcagatggttgtagatatgtggtgttacttctgaggcctctgttctgttccattggtctatatatctgttttggtaccagtaccatgctgtttttttaaaatgtagccttgtagtatagtttgaagtcaggtagcatgatgcctccagctttgttctttttgcttaggattgtcttggcaatgcagcctcttttttggttccatatgcattttagagtagttttttccaattctgtgaagaaagtcattggtagcttgatggggatggcattgaatctataaatcaccttgggcagtatggccattttcatgatattgaggcttcctatccatgagcatggaatgttcttccatttgtttttgtcctcttttattttgttgaggagtggtttgtagttctccttgaagaggtctttcacatcccttgtaagttggattcctaggtattttattctctttgtagcaatcgtgaatgcgagttcactcatgatttggttctctgtctgttattggtgtacaggaatgcttgtgatttttgcacattgattttgtattctgagactttgctgaagttccttatcagcttaaggagatttggggctgagacgatgggattttctaaatatacaatcatgtcatctgcaaacagggacaatttgacttcttcttttcctacctgaatacgcatcatttctttctcttgcctgattgccctggccagagcttccattaatatgttgaataggagtggtgagagagggcatccttgtcttgtgccggttttcaaagggaatgcttccagtttttgcccattcagtatgatattggctgtgggtctgtcataaatagctcttattattttgagatacattccatcaatacctagtttattgagagtttttagtatgaagagctgttgaattttgtcgaaggtattttctgcatctattgagataatcatgtggtttttgtcattggttctgtttatgcgatggattacatttattgatttgcttatgttaaacaagatttgcatcccagagatgaagccgacttgatcatggtggataagctttttgatgtgctgcgggattcggcttgccagtattttactgaggattttcacatcaatattcatcagggatattggtctaaaattctttttttttgttgtttctctgccaggctttggtatcgggatgatgttggcctcaaaataagttagagagggttccttctttttctattgattggaatagtttcagaaggaatggtaccagctcctctttgtgcctcttgtagaattcggctgtgaatccatctggtcctggactttttttggttggtaggctattaattattgcctcaatttcagaacctgttattggtctattcagagattcaacttcttcctgatttagtcttgggagggtgtatgtgtccaggaatttatccattttttctagattttctagtttctttcatagaggtatttatagtattctctgatggtagtttgtatttctgtgggattagtggtgatatcccctttatcattttttattatgtctatttgattcttctctcttttcttccttattaatcttgctagtggtatattttgttgatcttttcaaaaaaccagctcctggattcgttgatttttttgaaggttttttttttgtgtctctacctccttcagttctgctctgatcttagttattttttgccttctgctagcttttgaatttgtttgctcttgcttctctagttcttttaattgtggtgttagggtgtggattttagatcttttttgctttctcttgtggacatttagtgctataaattcccctctacactttgttttaaatgtgtcccagagattctagaacgttgtgtctttgttctcatttgtttcaaataacttatttctttctttttttttatggcttaacatatttttaatacgtttaggtgaaaatagtgtttcgtttctatgaggctgcatctgttttttgtttttgtttttgtttttaattttattattattatactttaagttttagggtacatgtgtacaatgtgcaggttagttacatatgtatacatgtgccatgctggtgtgctgcacccattaactcatcatttagcattaggtatatctcctaatgctatccctcccccgtccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaacttctcattttttatggctgcatagtattccatggtgtatatgtgccacattttcttaatccagtctatcattgttggacatttgggttggttccaagtctttgctatcgtgaatagtgccgcaataaacatacgtgtgcatgtgtctttatagcagcatgatttatagtcctttgggtatatacccagtaatgggatggctgggtcaaatggtatttctacttctagatccctgaggaatcgccacactgacttccacaagggttgaactagtttacagtcccaccaacagtgtaaaagtgttcctatttctgcacatcctgtccagcacctgttgtttcctgactttttaatgattgccattctaactggtgtgaggtggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagtttctggatattagccctttgtcagatgagtaggttgtgaaaattttctcccattttgtaggttgcctgttcactctgatggtagtttcttttgctgtgcagaagctcttgagtttaattacatcccatttgtcaattttggcttttgttgccactgcttttggtgttttagacatgaagtccttgcccatgcctatgtcctgaatggtaatgcctaggttttcttctagggtttttatggttttaggtctaacgtttaagtctttagtccatcttgaattagtttttgtataaggtgtaaggaagggatccagtttcagctttctacatatggctagccagttttcccagcaccatttattaaatagggaatcctttccccattgcttgtttttctcaggtttatcaaagatcagatagttgtagatatgtggtgttatttctgagggctctgttctgttccattggtctatatctctgttttgataccagtaccatgctgttttggctactgtagccttgtagtatagtttgaagtcaggtagcgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcatgatattgatccttcctacccatgagcatgggatgttcttccatttgtttgtatcctcttttatttcattgagcagtggtttgtagttctccttgaagaggtccttcccatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatagcttaaggagattttgggctgagacaatgaggttttctagatatacaatcatgtcatctgcaaacagggacaatttgacttcctcttttcctaattgagtaccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatacatagctcttattattttgagatatgtcccatcaatacctaatttattgagagtttttagcatgaagggttgttgaattttgtcaaagcccttttctgcatgtattgagataatcatgtggtttttgtctttggttctgtttctatgctggattacatttattgatttgcgtatattgaaccagccttgcatgccagggatgaagcccacttaatcatggtggacaagctttttgacgtgctgctggattcggtttgccagtattttattgaggatttttgcatcaatgttcatcaaagatattggtctaaaattctcttttttggttgtgtctctgcccggctttggtatcaggatgaagctggcctcataaaatgagttagggaggattccctctttttctatggattggaatagtttcagaaggaatggtgccagttcctccttgtacctctggtagaattcggctgtgaatccatctggtcctggactctttttggttggtaagctattgattattgccacaatttcagagcctgttattggcctattcagagagtcaacttcttcctggtttagtcttgggagggtgtatgtgtcaaggaatttatccatttcttctagatattctagtttatttgcgtagaggtgtttatagtattctctgatggtagtttgtatttctgtgggatcggtagtgatatcccctttatcattttttattgcgtctatttggttcttctctcttttcttctttattagtcttgctagtggtctatcaattttgttgatcctttcaaaaaaccagctcctggattcattaatttttgaagggttttttgtgtctctatttccttcagttctgctcggattttagttatttcttgccttctgctagcttttgaatgtgtttgctcttgcttctctagttcttttaattgtgatgttagggtgtcaattttggatctttcctgctttctcttgtgggcatttagtgctataaatttccctgtacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttcttttacatttgctgagaagagctttactaccaactatgtggtcaattttggaataggtgtggtgtggtgctgaaaaaaatgtatattctgttgatttggggtggagagttctgtagatgtctattaggtctgcttggtgcagagctgagttcagttcctgggtatccttgttaactttctgtctcgttgatctgtctaatgttgacagtggggtgttaaagtctccgattattaatgtgtgggagtctaagtctctttgtaggtcactccggacttgctttatgaatctgggtgctcctgtactgggtgcatatgtatttaggatagttagctcttcttgttgaattaatccctttacgattatgtaatggccttctttgtcttttaggatctttgttggtttaaagtctgttttatcagagactaggattgcaacccctgcctttttctgttttccatttgcttggtagatcttcctccatccttttattttgagcctatgtgtgtctctgcacgtgagatgggttcctgaatacagcacactgatgggtcttgcctctttatccaatttgccagtctgtgtcttttaattggagcatttagtccatttacatttaaagttaatattattatgtgtgaatttgatcctgtcattatgatattagctggttattttgccagttggttgatgcagtttcttcctagcctcgatggtctttacaatttgacatgattttgcagtggctggtaccggtttttcctttccatgtttagtgcttccttcaggagctcttgtagggcaggcctggtggtgacaaaatctgtcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttatgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcatgtacaccagtcagacgtagatttggtcttttcacatagtcccatatttcttggaggctttgttcatttctttttattcttttttctctaaacttcccttctcgcttcatttcattcatttcatcttccatcactgatacactttcttccagttgattgcatcggctcctgaggcttctgcattcttcacgtagttcttgagccttggctttcagctccatcagctcctttaagcacttctctgtattggttattctagttatacattcgtcttaatttttttcagttttcaacttctttgcctttggtttgaatttcctcctgtagcttggagtagtttgatcatctgaagccttcttctctcaactcatcgaagtcattctccgtccagctttgttccgttgctggtgaggagctgcgttcctttggaggaggagaggcactctgctttttagagtttccagtttttctgttctgttttttccccatcttggtggttttatctacttttggtctttgatgatggtgatgtacagatgggtttttggtgtggatgtcctttctgtttgttagttttccttctaacagacaggaccctcagttgcaggtctgttggagtttgctagaggtccactccagaccctgtttgcctgggtaccagcagtggtggctgcagaacagtggattttcgtgaaccgcgaatgctgctgtctgatcattcctctggaagttttgtctcagaggagtacccggcagtgtgagacgtcagtctgcccctactggggggtgcctcccagttaggctgctcaggggtctggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggtgcctactgaggcaggcaggcctccttgagctgtggtgggctccacccagttcgagcttcctggctgctttgtttacctaagcaagcctgggcaatggcaggcacccctcccccagcctcgctgccaccttgcagtttgatctcagactgctgttctagcaatcagcgagactccctgggcataggaccctctgagccaggtgcgggatacaatctcctggtgtgccattttttaaacctgttggaaaagcgcagtattggggtgggagtgacctgattttccaggtgccatctgtcacctctttcttcgactaggaaagggaactccccgaccccttgtgcttcccgagtgaggcaatgcctcgccctgcttcagcttgcgcatggtgcactgcacccactgtcctgagcccactgtctggcactccctagtgagatgaaccccgtacctcagatggaaatgcagaaatcacccatcttctgcgtcactcacactgggaactgtagaccggagctgttcctattcggccatcttgactccagcc

SEQ ID NO: 12494 - DNA, 9130 bp, Homo sapiens
ggtgtatatgtgccgcattttcttaatccagcctatcattgatggatatttgggttggttccaagtcgtctttgctattgtgaatagtccgcaataaacatacgtgtgcatgtgtctttatagtaaaatgatttgtaatcctttgggtatatacccagtaatgggattactgggtcaaatggtatttctagttctagatccttgaggaatcaccacactgtcttccacaatggttgaactaatttacacgcccatcaacagtgtaaaagagttcctatttctccacatcctctccagcatctgttgttacctgactttttaatgattgccattctaactggtgtgagatggtatctcattgtggttttgatttgcatttctctgacgacctgtgatgatgagcattttttcatgtgtctgttggctgcataaatgtcttcttttgagatgtgtctgttgatatcctttgcccacttttttgatggggttgtttgattttttcttgtaaatttgtttaagttctttgtggattctggatattagccctttgccaagtgggtagactgcaaaaattttctcccattctgtaggtttcctgttcactctgatgatagtttcttttgctgtgcagaaggtctttagtttaattagattttacttgtctattttggcttttgttgccattgcttttggtgtttcagtcatgaagtctttgaccatgcctatgtcctgaatggtattgcttaggttttcttctagggtttttatggttttaggtcttacatttaggtctttaatccatcttgaattaatttttctataaggtataaggaagggatccagtttcagctttctgcatatggctagccagttttctcaacaccatttattaaatagggaatcctttccccactgcttgtttttgtcaggtttgtcaaagatcagatggttgtagatatgtggtgttacttctgaggcctctgttctgttccattggtctatatatctgttttggtaccagtaccatgctgtttttttaaaatgtagccttgtagtatagtttgaagtcaggtagcatgatgcctccagctttgttctttttgcttaggattgtcttggcaatgcagcctcttttttggttccatatgcattttagagtagttttttccaattctgtgaagaaagtcattggtagcttgatggggatggcattgaatctataaatcaccttgggcagtatggccattttcatgatattgaggcttcctatccatgagcatggaatgttcttccatttgtttttgtcctcttttattttgttgaggagtggtttgtagttctccttgaagaggtctttcacatcccttgtaagttggattcctaggtattttattctctttgtagcaatcgtgaatgcgagttcactcatgatttggttctctgtctgttattggtgtacaggaatgcttgtgatttttgcacattgattttgtattctgagactttgctgaagttccttatcagcttaaggagatttggggctgagacgatgggattttctaaatatacaatcatgtcatctgcaaacagggacaatttgacttcttcttttcctacctgaatacgcatcatttctttctcttgcctgattgccctggccagagcttccattaatatgttgaataggagtggtgagagagggcatccttgtcttgtgccggttttcaaagggaatgcttccagtttttgcccattcagtatgatattggctgtgggtctgtcataaatagctcttattattttgagatacattccatcaatacctagtttattgagagtttttagtatgaagagctgttgaattttgtcgaaggtattttctgcatctattgagataatcatgtggtttttgtcattggttctgtttatgcgatggattacatttattgatttgcttatgttaaacaagatttgcatcccagagatgaagccgacttgatcatggtggataagctttttgatgtgctgcgggattcggcttgccagtattttactgaggattttcacatcaatattcatcagggatattggtctaaaattctttttttttgttgtttctctgccaggctttggtatcgggatgatgttggcctcaaaataagttagagagggttccttctttttctattgattggaatagtttcagaaggaatggtaccagctcctctttgtgcctcttgtagaattcggctgtgaatccatctggtcctggactttttttggttggtaggctattaattattgcctcaatttcagaacctgttattggtctattcagagattcaacttcttcctgatttagtcttgggagggtgtatgtgtccaggaatttatccattttttctagattttctagtttctttcatagaggtatttatagtattctctgatggtagtttgtatttctgtgggattagtggtgatatcccctttatcattttttattatgtctatttgattcttctctcttttcttccttattaatcttgctagtggtatattttgttgatcttttcaaaaaaccagctcctggattcgttgatttttttgaaggttttttttttgtgtctctacctccttcagttctgctctgatcttagttattttttgccttctgctagcttttgaatttgtttgctcttgcttctctagttcttttaattgtggtgttagggtgtggattttagatcttttttgctttctcttgtggacatttagtgctataaattcccctctacactttgttttaaatgtgtcccagagattctagaacgttgtgtctttgttctcatttgtttcaaataacttatttctttctttttttttatggcttaacatatttttaatacgtttaggtgaaaatagtgtttcgtttctatgaggctgcatctgttttttgtttttgtttttgtttttaattttattattattatactttaagttttagggtacatgtgtacaatgtgcaggttagttacatatgtatacatgtgccatgctggtgtgctgcacccattaactcatcatttagcattaggtatatctcctaatgctatccctcccccgtccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaacttctcattttttatggctgcatagtattccatggtgtatatgtgccacattttcttaatccagtctatcattgttggacatttgggttggttccaagtctttgctatcgtgaatagtgccgcaataaacatacgtgtgcatgtgtctttatagcagcatgatttatagtcctttgggtatatacccagtaatgggatggctgggtcaaatggtatttctacttctagatccctgaggaatcgccacactgacttccacaagggttgaactagtttacagtcccaccaacagtgtaaaagtgttcctatttctgcacatcctgtccagcacctgttgtttcctgactttttaatgattgccattctaactggtgtgaggtggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctcttgagtttaattacatcccatttgtcaattttggcttttgttgccactgcttttggtgttttagacatgaagtccttgcccatgcctatgtcctgaatggtaatgcctaggttttcttctagggtttttatggttttaggtctaacgtttaagtctttagtccatcttgaattagtttttgtataaggtgtaaggaagggatccagtttcagctttctacatatggctagccagttttcccagcaccatttattaaatagggaatcctttccccattgcttgtttttctcaggtttatcaaagatcagatagttgtagatatgtggtgttatttctgagggctctgttctgttccattggtctatatctctgttttgataccagtaccatgctgttttggctactgtagccttgtagtatagtttgaagtcaggtagcgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcatgatattgatccttcctacccatgagcatgggatgttcttccatttgtttgtatcctcttttatttcattgagcagtggtttgtagttctccttgaagaggtccttcccatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatagcttaaggagattttgggctgagacaatgaggttttctagatatacaatcatgtcatctgcaaacagggacaatttgacttcctcttttcctaattgagtaccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatacatagctcttattattttgagatatgtcccatcaatacctaatttattgagagtttttagcatgaagggttgttgaattttgtcaaagcccttttctgcatgtattgagataatcatgtggtttttgtctttggttctgtttctatgctggattacatttattgatttgcgtatattgaaccagccttgcatgccagggatgaagcccacttaatcatggtggacaagctttttgacgtgctgctggattctgtttgccagtattttattgaggatttttgcatcaatgttcatcaaagatattggtctaaaattctcttttttggttgtgtctctgcccggctttggtatcaggatgaagctggcctcataaaatgagttagggaggattccctctttttctatggattggaatagtttcagaaggaatggtgccagttcctccttgtacctctggtagaattcggctgtgaatccatctggtcctggactctttttggttggtaagctattgattattgccacaatttcagagcctgttattggcctattcagagagtcaacttcttcctggtttagtcttgggagggtgtatgtgtcaaggaatttatccatttcttctagatattctagtttatttgcgtagaggtgtttatagtattctctgatggtagtttgtatttctgtgggatcggtagtgatatcccctttatcattttttattgcgtctatttggttcttctctcttttcttctttattagtcttgctagtggtctatcaattttgttgatcctttcaaaaaaccagctcctggattcattaatttttgaagggttttttgtgtctctatttccttcagttctgctcggattttagttatttcttgccttctgctagcttttgaatgtgtttgctcttgcttctctagttcttttaattgtgatgttagggtgtcaattttggatctttcctgctttctcttgtgggcatttagtgctataaatttccctgtacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttcttttacatttgctgagaagagctttactaccaactatgtggtcaattttggaataggtgtggtgtggtgctgaaaaaaatgtatattctgttgatttggggtggagagttctgtagatgtctattaggtctgcttggtgcagagctgagttcagttcctgggtatccttgttaactttctgtctcgttgatctgtctaatgttgacagtggggtgttaaagtctccgattattaatgtgtgggagtctaagtctctttgtaggtcactccggacttgctttatgaatctgggtgctcctgtactgggtgcatatgtatttaggatagttagctcttcttgttgaattaatccctttacgattatgtaatggccttctttgtcttttaggatctttgttggtttaaagtctgttttatcagagactaggattgcaacccctgcctttttctgttttccatttgcttggtagatcttcctccatccttttattttgagcctatgtgtgtctctgcacgtgagatgggttcctgaatacagcacactgatgggtcttgcctctttatccaatttgccagtctgtgtcttttaattggagcatttagtccatttacatttaaagttaatattattatgtgtgaatttgatcctgtcattatgatattagctggttattttgccagttggttgatgcagtttcttcctagcctcgatggtctttacaatttgacatgattttgcagtggctggtaccggtttttcctttccatgtttagtgcttccttcaggagctcttgtagggcaggcctggtggtgacaaaatctgtcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttatgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcatgtacaccagtcagacgtagatttggtcttttcacatagtcccatatttcttggaggctttgttcatttctttttattcttttttctctaaacttcccttctcgcttcatttcattcatttcatcttccatcactgatacactttcttccagttgattgcatcggctcctgaggcttctgcattcttcacgtagttcttgagccttggctttcagctccatcagctcctttaagcacttctctgtattggttattctagttatacattcgtcttaatttttttcagttttcaacttctttgcctttggtttgaatttcctcctgtagcttggagtagtttgatcatctgaagccttcttctctcaactcatcgaagtcattctccgtccagctttgttccgttgctggtgaggagctgcgttcctttggaggaggagaggcactctgctttttagagtttccagtttttctgttctgttttttccccatcttggtggttttatctacttttggtctttgatgatggtgatgtacagatgggtttttggtgtggatgtcctttctgtttgttagttttccttctaacagacaggaccctcagttgcaggtctgttggagtttgctagaggtccactccagaccctgtttgcctgggtaccagcagtggtggctgcagaacagtggattttcgtgaaccgcgaatgctgctgtctgatcattcctctggaagttttgtctcagaggagtacccggcagtgtgagacgtcagtctgcccctactggggggtgcctcccagttaggctgctcaggggtctggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggtgcctactgaggcaggcaggcctccttgagctgtggtgggctccacccagttcgagcttcctggctgctttgtttacctaagcaagcctgggcaatggcaggcacccctcccccagcctcgctgccaccttgcagtttgatctcagactgctgttctagcaatcagcgagactccctgggcataggaccctctgagccaggtgcgggatacaatctcctggtgtgccattttttaaacctgttggaaaagcgcagtattggggtgggagtgacctgattttccaggtgccatctgtcacctctttcttcgactaggaaagggaactccccgaccccttgtgcttcccgagtgaggcaatgcctcgccctgcttcagcttgcgcatggtgcactgcacccactgtcctgagcccactgtctggcactccctagtgagatgaaccccgtacctcagatggaaatgcagaaatcacccatcttctgcgtcactcacactgggaactgtagaccggagctgttcctattcggccatcttgactccagcc

SEQ ID NO: 12495 - DNA, 8190 bp, Homo sapiens
tttgttttgttttatccttttttttattattatactttaagttttagggtacatgtgcacaacgtgcaggttagttacatatgtatacatgtgccatgttggtgtgctgcacccagtaactcgtcatttaacattaggtatatctccaaaggctattcctcccccgccccccatcccacaacagtccctggtgtgtgatgttccccttcctgtgtccatgtgttctcactgttcaattcccacctatgagtgagaacatgtggtgtttggttttttgtccttgcaatagtttgctgagaatgatggtttccagcttcatccatgtccctacaaaggacatgaactcatcattttttatggctgcatagtattctatggtgtatatgtgccacattttcttaatccagtctatcatttttggacatttgggttggttccaattctttgctattgtgaatagtgtcacaataaacatacatgtgcatgtgtctttatagcaacatgatttataatcctttgggtatatacccagtaatgggatggctgggtcaaatggtatttctagttctagatccctgaggaagcgccacactgacttccacaagggttgaactagtttacagtcccaccaacagtgtaaaagtgttcctatttctccacatcctctccagcacctgttgtttcctgactttttaatgatcaccattctgactggtgtgagatggtatttcattgtggttttgatttgcatttctctgatggccagtgatgatgagcattttttcatgtgtcttttggctacataaatgtcttcttttgagaagtgtgtgttcatatcctttgcccactttttgtgatggggttttttgtttttttcttgtaaatttgttagagttcattgtagattctgggtattagccctttgtcagatgagtagattgcaaaaattttctcccattctgtaggttgcctgttcactctgatggtagtttcttttgctgtgcagaagctctttagtttaattagatcccatttgtcaattttggcttttgttgccattacttttggtgttttagacatgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacatatggctagtcagttttcccagcaccatttattaaatagggaatcatttccccattgcttgtttttctcaggtttgtgaaagatcagatggttgtagatatgcggcattatttctgagggctctgttctgttccattggtctgtatctctgttttggtaccagtaccatgctgttttggttactgtagccttatggtatagtttgaagtcaggtagcgtgatgcctccagctttgttcttttgtcttaggattgacttggccatgcgggctcttttttggttccatatgaactttaaagaagttttttccaattctgtgaagaaagtcattggtagcttgatggggatggcattgaatctataaattaccttgagcagtatggccattttcacgatattgattcttcctacccatgagcatggaatgttcttccatttgtttgtatcctcttttgtttcattgagcagtggtttgtagttctccttgaagaggtccttcacgtcccttgtaaattggattcctaggtattttattctctttgaagcaattgtgaatgggagttcactcatgatttggctgtttgtctgttattggtgtttaagaatgcttggatttttgcacattgattttgtatcctgagactttgctgaagttgcctatcagcttaaggagattttgggctgagatgatggggttttctagatatataaatcatgtcatctgcaaacagggacaattcgacttcctcttttcttaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgtcatagatagctcttattattttgagatacgtcccatcaatacctaatttattgagagttttagttgttgaattttgtcaaaggccttttctgcgtctattgagataatcatatggtttttgtcgttggttctgtttatgtgctggattatgtttattgatttgtgtatgttgaaccagccttgcatcccagggatgaagccctcttgatcatggtggataagctttttgatgtgctactggattcggtttgccagtattttattgaggatttttgcatcgatgttcatcagggatattggtctaaaattctctttttttgttgtgtctctgccaggctttggtatcaggatgatgctggcctgataaaatgagttagggaggattccctctttttctattgattggaatagtttcagaaggaatggtaccagctcttccttgtacctctggtagaatttggctgtgaatccatctggtcctggactttttttggttggtaagctattaattattgcctcaatttcagagcctattattggtctattcagagattcaacttcttcctggtttagtcttgggagggtatatgtgtcgaggaatttatccatttcctctagattttctagtttatttgcgtagaggtgtttatagtattctctgatggtagtttgtatttctgtgggatcggtggtgatatcccctttatcattttttattgcttctatttgatccttctctcttttcttctttattagtcttgctagcggtctatcaattttgttgatcttttcaaaaaacaagctcctggattcattgatgttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctgtaaatttccctctacacactgctttgaatgtgtcccagagattctggtatgttgtgtctttgttctcgttggtttcaaagaatatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgtcataatttccattcttttacatttgctgagaagtgctttacttccaactatgtggtcagtttcggaataagtgcggtgtggtgctgagaagaacatatattctgttgatttggggtggagagttctgtaaatgtctattagatccacttagtgcagagctgagttcagttcctggatatccttgttaactttctgtctcgttgatctatctaatgttgacggtggggtgttaaagtctcccattattattgtgtgggagtctaagtctctttgtaggtcactaaggacttgctttatgaatctgggtgctcctgtattgggtgcatatatgtttaggatagttagctgttcttgttgaattgatccctttaccattatgtaatggccttctttgtctcttttgatctttgttggtttaaagtctgttttatgagagactaggattgcaacccctgcctttttttgttttccatttgcttggtagatcttcctccatccctttattttgagcctatgtgtgtctctgcacgtgagatgggtctcctgaatatagcacactgatgggtcttgactctttatccaatttgccagtctgtgtcttttaattggagcatttagtccatttacatttaaggttaatagttatgtgtgaatttgatcctgtgattatgatgttagctggttattttgctcgttagttgatgcagtttcttcctagcttcaatggtctttaaaatttggcatgtttttgcagtggctggtaccggttgttcctttccatgtttagtgcttccttcaggagctcttttagggcaggcctggtgatgacaaaatctctcagcatttgcttgtctgtaaagtattttatttctccttcacttatgaagcttagtttggctggatatgaaattctgggttgaaaattcttttctttttcttttcttttttttttttgagacagagtttcgctcttattgcccaggctggagtgcagtggtgtgatctgggctcactgcaacctccgccttctggtttcaagcgattctcctgcctcagcctcctgagtagctgggattacaggtgtctgccactacgcccgggtaatttttttttttgtatttttagtagagacagggtttcaacatgttggccaagctggtctcaaactccagacctcatgattctcccgccttggcctcccaaagtgctgggattacaggtgtgagccaccgcacccggcagaaaattcttttctttaagaatgttgaatattggcccccccactcttctggcttgtagggtttccgccgagagatcagctgttagtctgatgggcttccctttgtgggtaagccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattgaggaagttctcctgtataatatcctgcagagtgttttccaactcggttccattctccccgtcactttcaggtacaccaatcagacgtagatttggtcttttcacatagtcccatatttcttggaggctttgttcgtttctttttattcttttttctcagactgacacctcacacgggccgttactcctctgagacaaaacttccagaggaacgatcaggcagcgacatttgctgttcaccaatatccgctgttctgcaccctccgctgctgatacccaggcaaacagggtctggagtggacctccagcaaactccaacagacctgcagctgagggtcctgactgttagaaggaaaactaacaaacagaaaggccatccacaccaaaaacccatctgtacgtcaccatcatcaaagaccaaaggtagataaaaccacaaagatggggaaaaaacagagtagaaaaactggaaactctaaaaatcagagtgcctctcctcctccagaggaacacagctcctcaccagcaatggaacaaagctggacggagaatgactttgatgagttgagagaagaaggcttcagacgatcaaactactccgagctaaaggaggaagttcgaacccatggcaaagaagttaaaaaccttgaaaaaaaattagacgaatggctagctagaataaccaatgcagagaagtccttaaaggacctggtggagctgaaaaccaaggcacgagaactatgtgacgaatgcacaagcctcagtagccgattcaatcaactggaagaaatggtatcagtgatggaagatcaaacgaatgaaatgaagcgagaacagaatgtgtataaatgttaaccaaagacataaaataatgtttatagcaacttttttcataatagccccaaactaaaaactacccaaatgcacatcagccaaagaatggatacaaaaatgatggtatattcacgcaaggaaatactatatagcaatgtgttgggaggcagatctgcacagatcactcatgttcctgcatgggctaggccttctgaacaatgtttgaacagcagccttggatattgagatagtgcatccctctggagagatttagagacagttcagcgtaagaaacatagaaatgccccacccctccccacaaccaggagattgctgacattccagggtaatgaataatctctggctatggaggggaggacaggcaggtgtgtcagcaagttcacaacagcttagtctcctaattttagtttcttcccgcatgatgcaacccactgaacgcacaggaaatatctggcttcgtgtgagctggggcatgaggaattgatgcaaggtatagctctggctgctgattttgtggtaatcaatgatccatttttctgattcatgatcgtgtgtgtgtgtgtgtgtgtgtgtgtgtgtgtgtgtgtgttttgagacaaaatttcactctgtcacccaggctggagtgcagtgtcgtgttcatagctgactgcagcctcgacctccaggactcaagcaatcctcccacctcagcctcccaagtagctgagactacaagcatgtgccatcaagcccctaattttttttaatttgtttgtagcaacagagtctagctatgttgcccaggctggggtcttgtgttttatatatctgtgtgtatgcacatgtgcatgtatgtgtgtctgtgcaaaatttggcaggctaactttttagcttgcaagtagggtaaactcaaacccttcacagttctgacttacaatgaaactgaagaaaggataattccatgtgcataacagggatggacctcacaaacaatgttgggcaaaagaagctgcaggacacagaaggataatactatatgattccctttatacaaagttcaaaaacctggcttcatggccaggcatggtggctcatacctgtaatcccagcactttgggaggccgaggtgggtggatcacttgagatcagaagttcaagaccagcctgaccaacatggtgaaaccccatctctactaaaaaaaagtacaaaattagccgggtatgatggtgcacatctgcaatcccagctacctgggaggctgaggcaggagaatctcttgaatcctggaggtggaggtcacagtgagccgagatcacaccattgcactccagcctgggcaacaagagcaaaagtctgcctcaagaaaaaaaaaagccaaaaaacaaaaaacctggcaacatgaaatcatgctgttcaagtcacagggaggtgcctgaggtactacgggacatggcttttttgtttctttctttcttttatttttatttatttattttgagatagactctcactgtcacccaggctggagtgcagtggtgccatcttagctcactgaaacctcgacctcctgggctcaagcaatccccctgccttagcctcccaggtagctgagactacaggcgcactcggcctccagtgttgattctttttgcctgaaatacggatatacctttccatttattctggtcatttttttcttctgtcaaaatgtatagagctcatattttcttttctttttttttttgaaacggagtctcgctgtgtcaccaggctggagtgcagtggcgcgatctcggctcactgcaatctccgcctcccaggttcaagcgattcccctgctgcagcctcccaagtagctgggactacaggcgtgcaccaccacacccagctaattttttgtattttagtatgaacgaggtttcaccatgttggccaggatggtctcgatctcctgacctcataatctgcccacctcagcctcccaaagtgctgggattacaggcatgagccaccatgcctggccgagctcacacttttcttgcttacaagaggttgataaattttgttactgtgatcaacggtaccctgccctcttacattttctgatttcaggtgtctgtcaaggaaggctatacccatctttgttttttttttttcttgttttttttttttttttttttgagacggagtctcgctctgtcgcccaggctgaagtgcagtggtgctatctcggctcactgcaacctccgcctcccgggttcacaccattctcctgcctcagcctcccgagtagctgggactacaggcgccgaccaccacgcccggctaattttttgtacttttttagtagagacggggtttcaccatgttagccaggatgttctcaatctcctgacctcgtgatccacccgcctcggcctcccaaagtgctgggattacaggcattagccaccgcgcccggccc

SEQ ID NO: 12496 - DNA, 6076 bp, Homo sapiens
tagaatatttccactaaaatttatttatttatttatttattttatttttattttttttattatactctaagtattagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatgatgtctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcctaggtattttattctccttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatgtattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcctaaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttctttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaattcgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatcggacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaaatctgcagaggttactgctgtctttttgtttgtctgtgccctgcccccagaggtggagcctacagaggcaggcaggcctccttgagctgtggtgggctccacccagttcgagcttccaggctgctttgtttacctaagctagcctgggcaatggtgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccta

SEQ ID NO: 12497 - DNA, 24120 bp, Homo sapiens
aagctttttgatgtgctgctggattcagtttgccagtattttattgaggatttttgcattgatgttcatcaggaatattggtccaaaattctctttttttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctgtactttttttcattgataagctattaattattgcctcaatttcagagcctgttattgggctattcagagattcaacttcttcctggtttagtcttgggagggtgtatgtgttgaggaatttatccatttcttctagattttctagtttatttgtgtagaggtgtttatggtattctctgatggtagttagtatttctgtgggatcggtggtgatatcccctttatcattttttattacgtctatttgattcttctctcttttcttctttactagtcttgctagtggtctatcaattttgttgatcttttcaaaaaaccagctcctggattcattgattttttgaagggttttttgtgtctctatttccttcagttcttctctgatcttagttatttcttgccttctgctagcttttgaatgtgtttgctcttgcttctctagttcttttaattgtgatgttagggtgtcaattttagatcttgtcttctttctcttgtgggcatttagtgctataaatttccctctgcacactgctttgaatgtgtcccagagattctggtatgttgtgtctttgttctcattggtttcaaagaacatctttatttctgtcttcatttcgttatgtacccagtagtcattcaggagcagattgtccagtttccatgtagttgagcggttttgagtgagtttcttaatcctgagttctagtttgattgcactgtggtctgagagacagtttgttataatttctgttcttttgcatttgctcaggagtgctttacttccaactatgtggtcaattttggaataggtgtggtgtggtgctgaaaagaatgtatattctattgatttggggtggagagttctgcagatgtctattaggtccgcttggtgcagagctgagttcagttcctggatatccttgttaactttctgtctagttgatctgtctgatgttgacagtggggtgttaaagtctcccgttattattgtgtgggtgtctaagtctctttgtagctctctaaggacttgctttatgaatctgggtgctcctgtattgggtgcatatatatttaggatagttagcttttcttgttgaattgatcctttaccattatgtaatggccttctttgtctcttttgatctttgttggtttatagtctgttttatctgagactaagattgcaacccctgccttttttggttttccatttgcttggtagatcttcctccatccctttattttgagcctatgtgtgtctctgcacgtgagatgggtttcctgaatacagcaaactgatgagtcttgactctttatccaatttgccagtctgtgtcttttaattggagcatttagcccatttccatttaaggttaatattgttatgtgtgaatttgatcctgtcattaggatgttagctggttattttgctcgttagttgatgcagtttcttcctagccttgatggtctttacaatttggcgtgtttttgcagtggctggtaccggttgtttccatgttcagtgcttccttcaggagctcttttagggcaggcctggtcatgagaaaatctctcagcatttgcttgtctgtaaagtattctatttctccttcacttacgaagcttagtttggctggatatgaaattctgggttgaaaattcttttctttaagaatgttgaatattggcctcctgtctcttctggcttgtagagtttctgctgagagagcagctgttagcctgatgggcttccctttgtgggtgacccgacctttctctctggctgcccttaacattttttccttcatttcaactttggtgaatctgacaattatgtgtcttggagttgctcttctcgaagagtatctttgtggcgttctctgtatttcctgaatttgaatgttggcctgccttgctagattggggcagttctcctggataatatcctgcagagtgttttccaacttggttgcgttatccccgtcactttcgggtacaccaataagaggtagatttggtcttttcacatagtcctatatttcttggaggctttgtttatttctttttattcttttttctctaaacttctcttctcacttcatttcattcatttaatcttccatcacagatacgctttcttcctgttgatcgaatcggctactgaggcttgtgcattcatcacgtagttctcgtgccgtggttttcagctccatcaggtcctttaaggacttctctgcattggttattctagttagccattcgtctaatttatttttaaggtttttaacttctttgccatgggttcgaacttcctcctttagctcggagtagtttgatcgtctgaagccttcttctctcaactcgtcaaagtcattctccgtccagctttgttccgttgcaggtgaggagctgcgttcctttggaggaggagaggtgctctcatttttagagtttccagtttttctgctctgttttttccccatctttgtggttttatctaccttgggtctttgatgatggtgacaaacagatggggttttggtgtggatgtcctttctgtttgttagttttccttctaacagtcaggaccctcagctgcaggtctattggagtttcctggaggtccactccagaccctgtttgcctgggtatcagcagcagaggctgcagaacagtggatattggtgaacagcaaatgttactgcctgatccttcctctggaatttttgtctcagaggagtaccaggccgtgtgaggtgtcagtctgcccctactggggggtgcctcccagttaggctactcaggggtcagggacccacttgaggaggcagtctgtccattgtcagatctccagttgtgtgctgggagaaccactagtctcttcaaagctgtcagacagggacatttaagtctgcataggtttctcctgccttttgtttggctatgccctgcccccagaggtggagtctacagaggcaggcaggcctccttgaggtgctgtgggctccacccagtcgagcttcctggctgcttttttacctactcaagccttggcaatggttggcgcccctcccccagcctcgctgccaccttgcagtttgatctcagactgctgtgctagcaatgagcatggctccgtgggcataggaccctccaagccaggtgcgggatataatctcgtggtgtgccgtttgctaagaccattggaaaagcgcagtattaaggtgggagtgatccaattttccaggtgccgtctgtcacccctttatttgactaggaaagggaattccctgaccgcttgcgcttcctgggtgaggcaatgccttgccctgctttggctcatgctcggtgcactgcacccactgtcctgcacctactgtctgacactccccagtgagatgaacccagtacctcagttggaaatgcagaaatcacccatcttctgcgttgctcatgctgggagctatagactggagctgttcctatgcggccatcttgtctccacccctcaggacttgaattcttatgcagcagtcccagtgatctttagagaatgcacatcttgcagaacacctgaggtgaggagtttgagaccggcctggccaacatggcgaaaccctgtcactactaaaaatacaaaagttagctggacatgatggtgggcacctgtaatcccagctactcaggaggctgagacaggagaattgcttgaactcggaagatggaggttgtagtgagccgagattgtgtcactgcactccagcctagctgacagagtgagaccctgtctcaaaaaaaaaaaaaaaaaagagagagagagcatgtccattttggctctgatggtctcaccttgcttaggcattttaaaagtacacctgacaaggaggtgaaaatcctccctctaatactgtatctgcagttacagctaagaaaggccaaggcaagcattggaacctactgggaagttgaaaatttaggctgaagagctgcaaggggtgaccatttctgaaggtttgttagacagcagaatacttttacaaataaaattcctgaagtcaagactcttgggtcatctaaaattagacgggacaaacccttgagaatgagctactgacagggacatgagcaaggtgaactgatgactttttctatttctaatttctgtgagtctatagaaaggtctatttctttcagtattttataatgcatgtttctcctttagccttctttacattttttcctctgatatttttatagattctacttacaaagcttaaaattacaacaaaaatgccatttcatacattattaagtttagaccatttaaaatcctgtcttgcaaatttctcttcctacagagcaatgctgtcccatcatgttgccttatgtctgctgctatttttgaattacagcacatttcatccacctttgataaggaacttaatatccattggcaggtcaacttgtgactttatgctgtgactataactgcaaattatggtgcatatttcattttaagttattccctgggataggaagctggtccaacggcagaactttgtgttataaagactgaagaaggaatcttacagaaacaatgtttccacggtgggcaatgcttacaggatagaatgtcagggaagattgcaataaaatatatggaagggagttgggtgcaaaagagcaaacacataactggagagcaacagagatcagtgtgggattgaggagtccagaaaaggttaagcatggagctgaggttcagagagggacccaaggtctgactggtgcaggaagctaggccttcatgttttgaagattagaataaacagctgcaatattaggatctcaccatagaaggaagctgggcccaggaaggagctggcacacaggctatggctttggcaaagggaaaggctgtggacactaaaccaacttttaagttgagctctgaagttctataatcatcgtgtcaggtcagaagctagtgttagtagcctgaaggcgcaggcatagggaaataagaatattggggaggaatatcatggagtgagatttagaggaagagagatggttactgactttacatctctagatgtacatgggcctcccttaattttaatattctttgcttttcggcttttgttcagatactgtatcctctatcttggaagtaaagtgaaagggaattaaacaaacatttctagaatatctaccatttaaaaggtacttggataagcacttaacatatgtactcattgagctgttccaggagagtgggttattgttatctccatttcacagacaatacacaagctcaaaggttaagtaactcaccctagtgtgcacaattaataaatgggggcctttagattcacttccaggtgtgtgtgtgtgtgattccagagtcctcactcctttcactctaccatactgcttcctacagatagatgtctaggatcagactccagggactgggcctggcacacagcaggccctctgtaaatcgttgaattcctctctccctccctgtcctccaccccttctaacctctttaaagtccactgctttattttcaggtttttagttgactctatagagttattgtgttaggttataaaatcacctgcatattctctttcttttcatgaaggaggataatatcctgaatttggaaattttggataattttttttgggggagagggtaaagcaaggattgatacattttttttcttattcttaaaagccagactctcagactcttggaatataatggtttttaagaaattcatgaaataaagggattttccaatttttcagagaaagtggaaaaaaagggctctatttcaacctacatgatttagctccttgggcccaatgacagcacaggtccacatgtctgaagctcactttcttgcatcattgttgtttctgctgctcagctcttcctgatcttattcctaatcatgtgactgttaagtctgcactttgctggccctcccacttgtcttccagccttgtatttttagatatctacaggacattgctaattggagctcaagatgtgaaaaactgacaactccataatttttcttcaattttccccaccaaatatgcatcttttctcaattctggaattctaatggtcttttggtcctcattggaataatttttgaccacttcctctaatttccactgccactggaatggacttaaaatgaatgatctcaagtaccaagtgggcatccaacatggcgctaaaatcctaatacagttccctagtaatttacttctttctttctgagatgattttatccttttttccttgaacctcctaagcttcctctatgttctcaataactcatccagatgacctgcatcaagtaccacatcatctgccttccttctgcttctatgaaagaagcgtgcctgctcctgccattccactgtgctcagggtcccattctctttcaccttcttaacatcttccattcagcattatcccttccctgtcttggaaaatctatttctttctctctgttgaatcattctgctaaacacaaaaatacaacttagtatcacgtatctcagagaacatcctcctttgatctcatagccctcctctggcattgtatcactcctctgctccccttcacagaaacattccagcaaagagccgcccacctctctcatcccttagtctttcctcaaccctccctaactggtctgtcttctaccactccactactgtggccattgtcaagctcaccaatgacctccctcttgcacaagcagtgatttatatacccaatcaggggtgctcacccagcctaaccgccacctttccttagagtgccccctcctcaaagctctcaggaccctttcctaccttgttttcctcttaccttgttggccacacatgatcagtttcttttggaagctctcctcctctacaagaccttgcttgaaaagcccaaggacgttatcttaggctctcttctctttcgtttttaaattctcttcctagaaaattatctccagttatgtagtccctcccccaccatatttatgtggtttaaagtgccatctgcaagcgtattactctcaaatttacatacagctccagatgtgatcaccagcctgagcttcagactcagatagccaactgtctacctgacaccaccattttgaaatccacaagtatctcaaacataacacagctgaaatataattacagatgtcagccttcatccactctcctcttctcaagccttccccgtatcagtaaatggtcctaccattcactcatacccaaacctaaaggttaaacttgaatcctttctttatcctataacctacaatagtaagtctcaacagttccattccatgaatataacccaaccaatccacttatcgttattttcctggctacacacctcatgtaagccaccataagttttcatcccaactagcagagcagcaaggctcctacctctactcctgctgttctaacacccatgctcctcatagcaaccacaatgatctctttaaaatgtataacatcaaaataccttaaaaaagtacaatctaaactccgaaccgcagtccagagggccctaaaaaatctggcctcttcctatttctctgatgaagtcttccttgactctccatcttgttactgtttttcagccacactggccttctttccgtcctttgagtatccccagtcctgactcaggggctttgtacttgctctgtcttctgtttggaatacatttcttctgtatctttgaatagtctttgaatagttttttctctttaaattagttttaccttaaatgtccccttctcagagaggacttccctgacaaactgagtggccttatcacctctacaaaattaacctacatgatctttttcacatcccttctgtacctgaaattatcttatttatcaacttgcttgtttttgctgtctgtagttgtatcagatttatggcataaaaaatcactccaaacttagtactaaaacaaacatttattgagctcacaatcctttgggtgggccaattggactgagctcaaatgggtggtatctggattaggctgggtttatcatgcgtcagcggccaggtgggtggctcttcttctgggggttggttggctgttggctggggtaactgggcactggggctaggtttctcttatcatccagcaggccagcccaggcttactcacagggtggataacaggattcctgagagaacagaaatgtaccagttctcttgaggtttcgttttggcactagcacaatgtcccttctgcctcattcttttggtcaaagcagcccaaacactagaagtgggggaaatagtctctactgcttaaggggaagagctacagattacattgtaaagggatgtggatatggggagagaagaattgtaatcatttttgcaaacaacccaccacaaggatatatatttgcaattcatttgggattcttacaatttgaatccctttttgagtttaataaattaccttatgaatctttgtagggcaaagaatgtttcctcctgtaggagctgaacaagctacataatttctttccattaagggcacaggtacttgtgcaatttgggagagagcaaggtgcaatagtaggctccctgtggaattcattttctggttagggtgacagcaaagatgactgtgccaggttggtatcaccttatttgctgtacaattatgttcctggtgggaaagtagcaagagtgcaagctgtagcacctggggccctgctgcgatgagctggtgatttcctcatcaggccagttctatgaaaggttttatatgttgttcctggaatcttaagtttgaaacttattctttagccctcttgaagattctgtgagccactcagtattcttctattagattccttttctgtgtaattccccggggtcggatttggttgcttgcaatgaagagctctattttggcagctggcaccaggaatggggcttatttttcttatataacaggaagagtgaggtggttgctaaattagtccagttgctcacacagctatcaaggactcttatcttcctgcttggttgtccttagtgtattaacttgtaattttcatgcttgttgccccttagtggctccaggtattacttctgtgttctaggcaggaagggggaaaatgggacggcaccagctgtgtctgttcctcttatcaagaaagcaaaagtttctaggaagtgctccttttatcaagaaaggagcttctcttttgtcaagaaaggggtctaaaccgatcagctggccccctacaggcatcagtgattaggaagtacctggctttctagcctctatgaggaagtcatgcagggagaaagcttgagaatgtgccaaattaggtgatacccagtgcctatcccatgattagtttccccctttagaatgacagttcttggggtcggtggcaggggctctgatttattcattgctgtctcttctgggcccagaaaagcaactggcaaatatgcggtttcaaaattcattgatgactgactgatctttaatctgccatcaaggtctagagatttctttcttcaaaatgtgtcttatctcttgctttcattatagaaccaccattttatttcaggcctgtagtatattattaaaggttgttttcatgctgtatttctctctccagtcttttccatcctgtgtctgcattatattctgctactagtgtatcaccttgaataccatttttatcttgtccttttctttctcaaagtattagttatgttgtagtaaatcccagtctctcagcttgggatctgactccttgcataagctggtctgttgcctctctgacatcagcaatttatttggtaatcactcacaagtccagctaatctcatggccatctggtatacactgccacatccagtgtatgcaaagggagcaggctgcactgtgaagggaacaggaaagaccaggacagggaagactctcattctaggtgacaggtggccaagctgcttggctgtaaagggtagggccgtcaatgaccactcagtctgaacttgtgcttagtctgcagcctcaccagtggaactcatatcaggcacagggtctgactgggctgaagcaagactgggctggctcagtctaatccgtggggtgctcacaggagtcttgtcatcccagaggaaaagtggagtgtaaaccaggatcaacttctgtcacagagactggcccacagggcagaagttgcagaggaaggtgaaagtcagtggcatgtaggtgtccaagggcttgctgtccagcccagcaggaaacacatcattcctgaactctgagagaacttgggaccaggaacttggttcttcttggtctgaggctggaaacacatcattcctgaactctgagagaacttgggaccaggaacttggttcttcttggtctgaggctggaaacacatcattcctgaactctgagagaacttgggaccaggaacttggttcttcttggtctgaggctggaaacacatcattcctgaactctgagagaacttgggaccaggaacttggttcttcttggtctgaggctggaaacacatcattcctgaactctgagagaacttgggaccaggaacttggttcttcttggtctgaggctggcaaggaagagcactttgtgttggacctcagtgttggcagctaagctgttggatctggcaggcactggtctatcttccacttgcctttagttctctacctttatgagtgccctaccttttgttagaagcacattattttctggtatgctacaagtgatattttgaaaagctctggagacaattaggacacatctgaatttgtttgatgaaagtaatttaaatcatttttacaataaaacagaataaacatggataaaattggcatgctgtttcagacaaaattaagacttaaatttgaagctctgattacaattctggtttatgattatgtattcattcttttctttcattaggggtacttaaatggaaagaattgaaacacagaattctaaggcaaataaaaggccactagaagcactgtaattattatggaagttgttcattagagatacatatgctaggaatttaaatcagaactcagaaatttccatttttagaatgaattaaaaagaccatgtatgagattttaaaaaatattctttaacaggaagggagaatttgtgatgatagcatatagtgggaaggatgggaataaaactgctatttgaagagaatatctactttttaaggtaaaaatctcaagtcagtttaaaataatttcaaggtatttttcttactcaaaaatccctataataaataaacatttaaaataaataaatattaaaatgaataattccttctgaatagtatacttttattctagaatgtctatttcctctaagaaggatcctccaaacatttttttttttttttgagatggagtctttctctgttgcccagggtggagtgcagtcgcgcgatctcagctcactgcaagctccacctcccaggttcacgccattctcctgcctcagcctcccgagtagctgggactacaggcgcccgccaccatgcccagataattttttgtatttttagtagagacagggtttcactctgttagccaggatggtcttgatctcctgacctcgtgatccgcccgcctcagcctcccaaagtgctgggattacgggtgtgagacaccacgcctggccccctccaaacattttaaactaacaactttaatctaactgcttggttagaatgagaattccctgtgtcatctcctcttagcaaactgcaatcttttaacatcttaatacttctctctggcagggtgctaggagcataccaggggagatttctccaaaatcgcttcttccactggctgcttccaataatttatttgaaatctcaaggactgcttattactcaaaaagaaaagtataaacccagagtctactcgcctgattatgctaagcataaaatgctttattgttttaaataattagaaattattttgtggattgacttgtctctcaaacttgattatatgttttgaggatagctgtatttactatcattattaataaagctatttccttttattataaaagaaaatatatgctcttacagtatttcaaacactctggaagacttgctacagaagaggtgatttattcctgaccatcacattctttggaggaattagcttttttcattctttcatttagcaaataaattattgaaatctgatgaagtgattataagtcaataattttgtctaaattaaaaataagtttagtcaaacaacaagaatgataatgatacattgtaatttagtgttgcttagaaaattcttgggatatatagaatgctattttatttaataattctgtttctccataagactataatagacttcaagagctttttcattcttgtcctatgcattaatcaggatcgctgtgaattttaattcagagtacatttagatcggtttcatctgttcaacaactgatggaaatgtgaaattccattgtgatttttggggtacacttgttacctcagcataacctagactctcttgtccattataggccctacctatatcacaactgtaaatctacaatttctggagtttgtttcattgcatgaacaataatattcacctccttcacaattctttgtctcttagctatcccatgactcaaattatctcctctacatgaatacctttcaaatcttctcttattctgatccctctccaaatttccaatataagattaataactttcagacatcaccacctagatgtctatgacctcaaatctgttacaaataggatggatttacccaactcttgatttaacattgtttttgacacatgttgtctgtttttgttagtggtaccacagggttgtaagacttgagctccccacttaaacaaggacagagcaagtactcagtaagagccaactcttttcctctgtgatactcctgctctatgcagcttttgctgaactatgctctgtgtcagattatttaattacgatacattattcatttaaaggattaaataaattacccatctccttgccttctacaaccaatctattgttatgttattttgggtccacctctgaaattttttggaaataatttccttcctttctattcctattctcattactctaagtcaagcccttatgaactctggatttcactatttttagagctaccttaccggtttctgtcagcactgtgtcctccctccaaatcatttgacatagcaatgtcaaggacatcttcagttctgattatgtcatttccctgctcaaaaaccttcagcatttccatgttcaatagaatagaactaaaactccttagcccggcattttccatctccacagtatggtctccacacatacacaggcttcaatgttagatggagaatactactgcaaagtggttaagagccttcattatttactaattgtgtgacctttggttaattactactccctcctcaactccagtttttctacttggaaaaacagggataataatagtacatacttcctatagttgttatgaggattaaataattcatttaaagcattaacatgcctggtaaaatataagtaatcaagacattttattattattattattacagcatttttagatgagtacataaatacatgttgtatatttatggaacttgatatcaattcagttcttctctttatatgttttagaaatgggaacatgagtctacaggactgggaattatggctccctcaccattcagttcccatgtatttctcattagcaattatttctagatgaagggctatgcctgttgtgctgtatggagcacactgaatgttgtcatgattacttgcctaagcaggttattaatgaaactcaagtttccactaaaaagaagcaatgtactgatatatgctaaaacatagttgaacctcaaaaacattatgctaaataaacaatgccagacaaaagacctccatattgtgtgtccatttatataaaatgtccagaatagtcaagtctataaagcctagaagatagattagtggttgctttgggctgtgggtggaaatgaagaatgactgcaaatggagacaaagtgtttttttttgggttgatgaaaatgtgtacatatagttccatgtcattttatcacatctgtaaccaccaccacaagaaagatgcagaattgtttgatttcataaagatcttgcttgagctacccctttatggccatacatttttccctccccgcactatcgttaacccctgccaaccactaatctattctcaatctctgtaattatgacattttgagaatattatataaattaaatcatatagcatatgagttcattaccaataatttaacgtaattattgatattctaaggtttaagtctgccatattattttttgttttctattttctctgatttttcatttctttctttcatatacttcctgtggaatactttaacatattttagaattctattttgattctatattgtttgtaagcatatctctttgtatatatttttagtaactactctaagtattaaattgtacatacataactatcagtctactgatgtagacattttaccagtgttaagtgtagccctttaattctctttaccctccctcatttataattgttttaatatttcctctacttcattgagagccacataagaaaatattatacttttgcttcaattgtcaaaaacaatttagaaaattcagatggaaagtttattgtatttattcttatttttgttctttctgttgtccttttttctttccttatattcccaaattccttcttttatcatttactttctgtcagataacttccttcagtcattcttttagagtaattctgctggtgacaaatattcttagttttccttcatctgagcatgcctttgttacctgcattcctcaaggatatttttgccggacatagaactgtggttgacagctcttttactgtagcacttagaaaatggttgcaatatccttcggagcttcttgacttttgatgagaagtcggctgtcatttgaattgtttcccccttttcccttacaggtaatgtgtcatttctctctggttcctttcaaaattattttcgctgtctttagttttctgaagtttgatgatggtgtgtcttagtgtaaatttctttgggttttttgtccttggggtttgatcagtttcttaaatctgtagtttgtttttgctaaataagttttcaaccattatttctgggaaaatattttgaggcccacctgcttcctcctctccttctgagatcttttgttatagttctgcaagtccctgaggttctgttcaatttttttttcaatctattttctctctgttgttcagattgggtaatttctattgtactaccttcaagataactatataattatttcctgtcttttccatgatgctgttgagcccactcattgtgttttaaaattttgattactgtagttttcatttccagaatttccatttggttcttctttatatcttctatttctaaggctttctattatttcgtttgtttcaagtccatttggaattgcttgttgaagtagttgtatggcatctgctttaaaacccttgtcagataattccaactctgtgtcatgttgatgttgtcatttgttgactgaaagtcttttttttttttttgagacagggtctcactctgtcgcccaggctggaatgcggtggcaccgtctcggctcactgcaacctctgtctcctggcttcaatcagttctcatggctcagcctcccgagtaggctacaggtgcacatcaccatgcctggctaatttttgtattttttggtagaggcgatgtttcatcatgttggccaggctggtctcaaactcctgacctcaagtgatccacttgccttggcctcccaaagtactggggttacaggccactgtgcctggcctgactgaatgtcttttgtcattcaagttgagattttccttgttcttggtatgatgagtgctttttaaaggttgcattccggacattttgggtactatgttatgagactctgggtcctatttaaatcttgtgttttagaagacctcctttgacactgctggcagaggaaagggaactcactcctctttactaccagatgtggatggaagctctggccacttacactgcctcatttgacatcctgaggaggggtacaccttattactactgggcagggatgggacttcaggctttgatatggtttggctgtgtcttcatccaaatctcatcttgaattgtagcttccacaattcccacatgttgtaggagggaactggtgggaggtaactgaatgatgagggtgtgtctttcccatgctgttctcgtgacagtaagtctcatgagatctgatggttttataaaggggagtttccctgcataagctctgtctcttgcctgccataatgtaagaagtccctttgcccttccttcatcttctgccatgattgtgaggcctgcccagccatgtagaactttgagtcaattaaacctctttctttataaattaccgagtcttgggaatggctttattagcagcatgagaacagactaatacaggcttcctttgtggtctcatttaccctgcagagtggcggggagttggggagggatttgggcagacccattactgctaaatggtggtgaaagttctggcttccctctgggcttcttctgatacgaataagagggagtgtggtggctttactaccaggtggagatggaagtcttggttccccacttggccttcactgatatcatccagtgtagggaagagagggatgcctcattattgctggagaagggcacaggtcgaggcttcccaaggcagataagagtatggtgaggcctgggtattttcctgtggtgtttggctgcattgggcaggtattgcctaaatgttttctgtcttactagcttgcccctttcctggacccttggccagagagaggtgactttcattggagcattttaaatctgctcctatcggtgttttttggtcactggcttctctagcacctagtttgggatatatgggacaaaaagaaaacccagagaacacactgctgtgtcattccttgagttttgtgattcctagccctcctgtcttcttgtctgtgtctttcagtgtatttgctttatatataatgtccggggttttcggttgtacttagtgagaggaatagggagacgtggtctcctccatttcggtctggactattctctgcaactaatctgaccatttcgttttgccattctgccttacaatgtaggagtattgacttacatgacctacaagtaacttgcataaagacatgaaaaggcaaataatggggtttatcaaagatacctctccactgttaaaaattaagctttgaaatcctatcataagaatgaatgctaaataaaaagaaaacctaaaatattttcaacatgtggatatgtaattttttttgaaagaagcgatattcacaagaacaaaaaaccaaacaccgcatattctcactcataggtgggaattgaacaatgggaacacatggacacaggagggggaacattacactctggggactgttgtggggttgggggaggggggagggatagcattgggagatatacctaatgctagatgacgagttagtgggtgcagcgcaccagcatgtcacatgtatacatatgtaactaacgtgcacattgtgcacatgtatcctaaaacttaaagtataataaaaaaaaaccaaataaaaaacttagaaaaaaaaaaaaaagaaagaagcgatagtaccaaagacttgcacaagaatgttcatagaagtattatctgcaggagccccaaactggaaacaacctaaatgctattcaaatggtgaatgaataaataaaatacaataaaatatttgaaaataataaggaataaagtactaatatatgctactacatggatgaatctcaaaagcactatgctaagtgaaaaaagccagccataaaagatcacatatggcatgactccatttatatgaaatgttcaaaataggcaaatccataaagacagaaagtaaattcgtggttgcctagggctggtgtaggggtggtgggataggtacagtttctttctttctttctgaggtgttctaaacttagatcattgtaatcttggaacaactctgaatattctacaaatcactgaatcatccatttttttaaattatgctttaagttttagggtaaatgtgcacaacgtgcaggtttgttacatatgtatacatgtgccatgttggtgtgctgcacccattaactcttcatttaacattaggtatatctcccagtgctatccctcccctcttcccccaccccacaacaggccccagtgtgtgatgttcccctttctgtgtccatgtgttctcattgttcaattaccacctatgagtgagaacatgcggtgtttggttttttgtccttgcgacagtttgctgagaatgatggtttccagcttcatccacgtccctacaaaggacatgaactcatccttttttatggctgcatagtattccaaggtgtatatgtgccacattttcttgatccagtctatcattgttggacatttgggttggttccaggtctttgctattgtgaatagtgctgcaataaacatacatgtgtatgtgtctttatagcagcatgttttataatcctttgggtatatacccagtaatgggatggctgggtcaaatggtatttctagttctagatccctgaggaatcactacactgacttccacaatggttgaaccagtttacagtcccagtaacagtgtaaaagtgttcctatttctccacatcctctccagcacctgttgtttcctgactttttaatgattgccattctaactggtgtgagatggtatctcattgtgcttttgatttgcatttctctgatggccagtgatgatgagcattttttcatgtgtcttttggctgcataaatgtcttcttttgagaagtgtctgttcatatcctttgcccacttgttgatggggttgtttgtttttttcttgtaaatttgtttgaggtcattgtagattctggatattagccctttgttagatgagtagatggcaaaaattttctcccattctgtaggttgcctgttcactctgatggtagtttcttctgctgtgtggaagctctttagtttaattagatcccatttgtcaatttttgtttttgttgccattgcttttgatgttttagacatgaagtgcttgcccatgcctatgtcctgaatggtattgcctaggttttcttctagggtttttatggttttaggtctaacatttaagtccttaatccatcttgaattaatttttgtataaggtgtaaggaagggatcctgtttcagctttctacatatggctagccagttttcccagcaccatttattaaatagggaatcttttccccatttcttgtttttgtcaggtttgtcaaagatcagatggttgtagatatgcggcattatttctgagggctctgttctgttccgttggtctatatctctgttttggtaccagtaccatgctgttttggttactgtagccttgtagtatagtttgaagtcaggtagcgtggtgcctccagctttgttcttttgccttaggattgacttggcaatgagggctcttttttggttccatatgaacttgaaagtagttttttccaattctgtgaagaaagtcattggtagcttgatggggatggcattgaatctataaattaccttgagcagtgtggccattttcacgatattgattcttcttacccatgagcatggaatgttcttccatttgtttgtatcctcttttatttcattgagcagtggtttgtagttctccttgaagaagtccttcacatcccttgtaagttggattcctaggtattttattctctttgaagcaattatgaatgggagttcactcatgatttggctctctgtttgtctgttattggtgtataagaatgcttgtgatttttgtacactgattttgtatcctgagactttgctgaagttgcctatcagtttaaggagatttgggactgagacgatggggttttctagatatacgatcatgtcatctgcaaacaggacaatttgacttcctcttttcctacttgaacaccctttatttccttctcctgcctgattgccctggccagaacttccaacactatgttgaataggagtggtgagagagggcatccctgtcttgtgccagttttcagagggtatgcttccagtttttgcccattcagtatgatattggttgtgggtttgtcatagatagctcttattattttgagataattcccatcaatacctaatttattgagagtttttagcatgaagagttgctgaattttgtcaaaggccttttctgcatctattgagataatcatgtggtttttgtcgttggttctgtttatatgctggattacgtttattgatttgtgtatgttgaaccagccttgcatcccagggatgaagcccacttgatcatggtggataagctttttgatatgctgctggattcattttgccagtattttactgaggatttttgcatcgatgttcatcagggatatcggtctaaaattctctttttttgttgtgtctctgccaggctttggtatcaggatgatgctggcctcataaaatgagttagggaggattctctctttttctattgattggaatagtttcagaaggaatgataccagatcctccttgtacctctggtagaattcggcagtcaatccatctggtcctggactttttttggttgataagctattaattattgcctcaatttcagagcctgttattggtctattcagagattcaacttcttcctggtttagtcttgggagggtgtatgtgttgcggaatttatccatttcttctagattttctagtttattttcatataggtgtttatagtattctctgatggtagtttgtatttctgtgggatcggcggtgatatcctctttgtcattttttattgcatctatttgattcttctctcttttcttctttattagtcttgctagtggtctatcaattttgttgatcttttcaaaaaaccagctcctggattcattgattttttgaagggttttttgtgtctctatttccttcagttcttctctgatcttagttatttcttgccttctgctagcttttgaatgtgtttgctcttgcttctctagttcttttaattgtgatgttagggtgtcaattttagatcttgtcttctttctcttgtgggcatttagtgctataaatttccctctacacactgctttgaatgtgtcccagagattctggtatgttgtgtctttgttctcattgatttcaaagaacatctttattactgccttcatttcgttatgcacccagtagtcattcaggagcaggttgttcaatttccatgtagttgagcggttttgagtgagtttcttaatcctgagttctagtttgattgcactgtggtctgagagagagtttgttataatttctattcttttacatttgctgagaagtgctttacttccaactatgtggtcagttttggaataggtgtagtgtggtgctgaaaagaatgtatattctgttgatttggggtggagagttctgcagatgtctattaggtccacttggtgcagagctgagttcagttcctggatatccttgttaactttctgtctcgttgatctgtctaatgctgacagtggggtgttaaagtctcccattattattgtgtgggagtctaagtctctttgcaggtctctaaggacttgctttatgaatctgggtgctcctgtattcggtgcttatatatttaggatagttggctcttcttgttgaattgatccctttaccattatgtaatggccttctttgtctcttttgatctttgttagtttaaagtctgttttatccgagactaggattgcaacccctgccttttttggttttccatttgcttggtaaatcttcctccatccctttattttgagcctatgtgtgtctctgcacatgatgagatgggtttcctgaatacagcacactgatgggtcttgactctttatccaatttgccagtctgtgtcttttaattggagtatttagcccatttccatttaaggttaatattgttatgtgtgaatttgatcctgtcatgatgatgttagctggttattttgctcattagttgatgcagtttcttcctaactttgatggtccttacaatttggcatgtttttgcagtggctggtaccggttgttcctttgcatgttcagtgcttccttcaggagctcttttagggcaggcctggtggtgacaaaatctctcagcgtttgctcatctgtaaagtattttatttctccttcacttatgaagcttagtttggcttgatatgaaattctgagttgaaaattcttttctttaagaatgttgaatattggcccccactctcttctggcttgtagggtttctgccgagagatctgctgttactctgatgggcttccctttgtgggtaacccgacctttctctctggctgcccttaacatttattccttcatttcaactttgctgaatctgacaattatgtgtcttggagttgctcttctcgaggagtatctttgtggtgttctctgtatttcctgaatttgaatattggcctgccttgctagattggggaagttctcctggttaatatcctgcagagtgttttccaacttggttgcactctcctcatcactttcaggtacaccaatcagacgtagatttggtcttttcacatagtcccatatttcttggaggctttgtttgtttctttttattctttttttctctaaacttctcttctcacttcatttcattcatttgatcttccaccactgataccctttcttccagttgatcgaatcggctactgaggcttgtgcattcgtcacgtagttctcgtgccatggttttcagctccatcaggtcctttaaggacttctctgtattggttattctagttatccattcgtctaattttttttcaaggtttttaacttctttgccatgggttcgaacctcctcctttagctcagagtagtttgatcgtctgaagtcttcttctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtgtttgataatggtgacaaacagatggggttttggtgtggatgtcctttctgtttgttagttttccttctaacagtcagtaccctcagctgcaggtctgttggagtttcctggaggtccactccagaccctgtttgcctgggtatccgcagcagaggctacagaacagtggatattggtgaacagcaaatgttactgcctgattgttcctttggaagttttgtctcagaagagtacccagctgtgtgaggtgtcagtctgcccctactggggggtgcctcccagttaggctactcggggg

SEQ ID NO: 12498 - DNA, 7969 bp, Homo sapiens
aatttcttttttttttattgcactttaagttttagggtacatgtgcaaaacgtgcaggtttgttacatatgtgtacatgtgccatgttggtgtgctgcacccactaactcgtcatttaacattaggtatatctcctaatgctatccctccccactcccctcaccccacaacaggccccggtgtgtgatgttccccttcctgtgtccaagtgtcctcattgttcaattcccacctatgagtgagaacatgcggtgtttggttttttgtccttgcgatagtttgctgagaatcatggtttccagcttcatccatgtccctacaaaggacatgaactcatccttttttatggctgcatagtattccatggtgtatatgtgccacattttcttaatccagtctatcattgttggacatttgggttggttccaagtcttcgctattgtgaatagtgccactataaacatacatgtgcctgtgtctttatagcagcatgatttataatcctttgagtatatacccagtaatgggatggctgggtcaaatggtatttctagttctagatccttgaggaatcaccacactgtcttccacaatggttgaattagttgacagtcccaccaacagtgtaaaagcgttcctatttctccacatcctctccagcacctgttgtttcctgactttttaatgatcgccattctaactggtgtgagatggtatctcattgtggttttgatttgcatttctctaatggccagtgatgatgagcattttttcatgtgtctgttggctgcataaatgtctccttttgagaagtgtctgttcgtatcctttgcccacttgttgatggagttgtttgtttttttcttgtaaatttgtttgagttcattgtagattctggatattagccctttgtccgatgagtagactgcaaaaattttctcccattctgtaggttgcctgttcactctgatggtagtttcttttgctgtgcagaagctctttagtttaattagatcccatttgtcaattttggcttttgttgccattgcttttgctgttttagacttgaagtccttggccatgcctatgtcctgaatggtattgcctaggttttcttatagggtttttgtggtatgaggtctaacacgtaagtctttaatccatcttgaattaatttttgtataaggtgtaaggaagggatccagtttcagctttctacatatggctagccagttttcccagcaccatttattaagtagggaatcctttccccatttcttgtttttgtcaggtttgtcaaagatcaggtggttgtagatacgtggaattatttctgagggctctgttctgttacattggtctatatctatgttttggtaccagtaccatgctgttttggatactgtagccttgtagtatagtttgaagtcaggtagcgtgatgcctccagctttgctcttttggcttaggattgacttggcgatgcaggctcttttttggttccatatgaactttaaggtagttttttccaattctgtgaagaaagtcattggtagcttgatgggggtggccttgaatctataaattaccttgggcagtatggccattttcacgatattgattcttcctacccatgagcatggaatgttcttccatttctttgtatcctcttttatttcattgagcagtggtttgtagttctccttgaagaggtccttcacatgccttgtaagttggattcctaggtattttattctctttgaagcaattgtgactgggagttcactcatgatttggctctctgtttgtctgttattggtgtataagaatgcttgtgatttttgcatattgattttgtatcctgaggcttttctgaagttgcttatcagcttaaggaggttttgagctgagatgatggggttttctaaatattcaatcatgtcatttgcaaatagggacaatttgacttcctcttttcctaattgaataccgtttattcctttctcctgcctgattgccctggccagagcttccaccactatgttgaataggagtagtgagagagggtgcccttgtcttgtgccaattttcaaatggaatgcttccagtttttgcccattcagtatgatattgtctgtgggtctgtcataaatagctcttattatttttatatatattccatcaatacttagtttattaagagtttttagcatgaagggctgttgaattttgctgaaggccttttctgcatctattgagataatcatgtggtttttgttgttggctctgtttgtatgctggattatgtttattgatttgcgtatgttgaagcagccttgcatcccggggatgaagcacacttgatcatggtcgataagctttttgaggtgctgctggattcggtttgccagtattttattgaggattttcgcatcaatgtttatcagggatattggtctaaaattctctttttttgttgtgtctctgccaggctttggtatcaggatgatgctggcctcataaaatgagttagggaggattccttctttttctattgatgggaatagtttcagaaggaatggtaccagctcctccttgtacctctggtagaattcggctgtgaatccatctggtcttggactttttttggttggtaagctattaattattgcctcaatttcagggcctgttattggtctattcagagattcaacttcttcctggcttagtcttgggagggtgtatgtgtccaggaatttatccatttcttctagattttctagtttatttgcatagaggtgtttatagtattctctgatggtagtttgtatttctgtgggatcggtggtgatatcccctttatcattttttattatgtctatttgagtcttctctcttttcttctttattagtcttactagtggtctatcaattttgctcatcttttcaaaaaaccagctcctggattcattgattttttgaagggctttttgtatctctatttccttcaattctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtatctttgttctcgttggtttcaaaggacatctttatttctgccttcatttcgttatgtacccagtagtcattcaggagcaggttgttcagtttccatgtagttgagtggttttgagtgagtttcttaatcctaagttctagtttgattgcactgtggtctgagagacagtttgttataatttctgttcttttacatttgctgaggagtgttttacttccaactatgtggtcagttttggaataggtgtggtgtggtgctgaaaagaatgtatattctgttgatttggggtggagatttctgtagatgtctattaggtccacttggtgcagagctaagttcgattcctggatatccttgttagctttctgtctctttgatctgtctaatgttgacagtgggatgttaaagtctcccattattactgtatgggagtctaagtctcttttttttttttttattgtccccctggcaaatctttttttcttttttcttttttttgtatttatttatttattttattgatcattcttgggtgtttctcgcagagggggatttggcagggtcataggacaatagtggagggaatgtcagcagataaacaagtgaacaaaggtctctggttttcctaggcagaggaccctgcggcctttcgcagtgtttgtgtccctgggtacttaaggttagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctacacagacacggcaaccatccgatttctcaatcttttccccacctttcccgtctttctattccacaaaaccgccattgtcatcttggcctgttctcaatgagctgttgggtacacctcccagacggggtcgtggccgggcagaggggctcctcaattcccagtaggggtggctgggcagaggcgcccctcgcctcccggacagggcggctggccgggcggggggctgacccccccacctccctcccggacggggtggctggctgggcagaggggctcctcacttcccagtaggggcagccgggcagaggcgcccctcacctcctggacagggcggctggccaggcaaggggctgaccccccccccacccacctccctcccggacggggcggctggccgggcggggggctgaacccccacctccctcccggacggggcggctggccgggcagaggggctcctcaattcccagtaggggtggccgggcagaggcgcccctcgcctcccggacggggcggctggccggatggggtggctggccgggcggggggctgacccccccacctccctcccggacggggcggctggccgggcagaggggctcctcacttcccagtaggggcggccaggcagaggcgcccctcacctcccggacagggcggctggccgggcggggggctgacccccccccacctccctcccagacggggcggctggccgggcagaggggctcctcacttcccagtaggggcggccgggcagaggcgcccctcacctcccgtccgggaggctggccgggtggggggctgacccccccacctccctcccggacggggcggctggcctggcgggggctgacccccacctccctcccggacggggtggctgccaggcagagatgctcctcacctcccagaccgggtggctgccggacggaggggctcctcacctctcagacagggcggttgccaggcagagggtctcctcacttatcagacggggcagccgggcagagacgctcctcacctcccagacggggtcgcggccgggcagaggtgctcctcacataccagacggggcggcggggcagaggcgctccccacatcccagacgatgggcggccgggcagagacgctcctcacttcctagatgggatggcgggggggaagaggcgctcctcatttcctagatgggatggcggccgggcagagacgctcctcactttccagactgggcagccaggcagaggggctcctcacatcccagacgatgggcggccaggcagagacgctcctcacttcccagacggggtggcggctgggcagaggctgcaatctccgctctttgggaggccaaggcaggcggctgggaggtggttgtagcaagccgagatcacgccactgaactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagtacagtccagctttggctcagcatcagagggagaccgtggaaagagagggagagggagaccgtggggagagggagagggagagggagaggtctaagtctctttgtagctttctaaggacttgatttatgaatctgggtgctcctgtattgggtgcatatatatttaggatagttagctcttcttgttgaattgatccctttaccattatgtaatggcctggtttgtctcttttgatctttgttggtttaaagtctgctttatcagagactaggattgcaacccctgcctttttttgttttccatttgcttggtagatcttcctccatccctttattttgagcctatgtgtgtctctgcacgtgagagggtttcctgagtacagcacactgatgggtcttgactctttatccaatttgccagtctgtgtcttttaattggagcatttagcccatttacatttaaggttaatattgttatgtgtgaatctgatcctgtcattatgatgttagctggttattttgcttgttagttgatgcagtttcttcctacccttgatggtctttacaatttggcatgtttttgcagtggctggtaccagttattcctttccatgtttagcgcttccttcaggagctcctgtagggcaggcctggtggtgacaaaatctctcagcatttgcttgtctgtacagtattttatttctccttcccttttgaagcttagtttggctggatatgaaattctgggttgaaaattcttttctttaagaatgttgaatattggcccccactctcttctggcttgtagagtttctgccaagagatcagctgttagtctgatgggcttccttggtgggtaacccgacctttctctctggctgcccttaatattttttccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccagcttgattccattctccctgtcactttcaggtacaccaatcagacatagatttggtcttttcacatagtcccatatttcttggaggctttgttcatttctttttattcttttttctctaaacttctcttctcgcttcatttcattgatttgatcttccatcactgataccctttcttccagttgatcaaatcagctactgaggcttctgcatttgccacgtagttctcgtgccatggtgttcagctccatcaggtcctttaaggacttctctgcattggttattctagttagccattcgtctaatcttttttcaaggtttttaacttctttgccatgggttcgaacttcctcctttacctcagagtagtttgatcatctgaagccttcttctctcaactcgtcaaagtcattttccatccagctttgttctgttgctggtgaggagctgtgttcctttggagaaggagaggcattctgatttttagaattttcagtttttctgctctgttttttaccccatctttgtggttttatctacctttggtctttgatgatggtgatgtacagatggggttttggtgtggatgtcctttccgttttttagttttccttctaacagtcaggactctcagctgcaggtctgttggagtttgctggcggtccactccataccctgtttgcctgggtatcagcatcagagtctgcagaacagtggatattggtgaacagcaaatgttgctgcctgatcgttcctctggaagttttgtctcagaggagtacctggccgtgtgaggtgtcagtctgcccctacttggggggtgcctcccagttgggctactcaggggtcagggacccacttggggaggcagtctgtctgttctcagatctccagctgtgtgctgggagaaccactactctcttcaaagctgtcagacggggacatttaagtctgcagaggtttctgctgccttttgtttggctatgccctgcccccagaggtggagtctacagaggcaggcaggcctccttgagctgcagtgggctccgcccagttcaagcttcccagccactttatttacctactcaagcctcagcaatggcgggcg

SEQ ID NO: 12499 - DNA, 16344 bp, Homo sapiens
  misc_feature (4124)..(4124): n equals a,t,g, or c
  misc_feature (4127)..(4127): n equals a,t,g, or c
  misc_feature (4130)..(4131): n equals a,t,g, or c
  misc_feature (4136)..(4136): n equals a,t,g, or c
  misc_feature (4141)..(4141): n equals a,t,g, or c
  misc_feature (4151)..(4151): n equals a,t,g, or c
  misc_feature (4162)..(4162): n equals a,t,g, or c
  misc_feature (4170)..(4170): n equals a,t,g, or c
  misc_feature (4202)..(4202): n equals a,t,g, or c
  misc_feature (4220)..(4220): n equals a,t,g, or c
  misc_feature (4229)..(4229): n equals a,t,g, or c
  misc_feature (4382)..(4382): n equals a,t,g, or c
  misc_feature (4391)..(4391): n equals a,t,g, or c
  misc_feature (4400)..(4401): n equals a,t,g, or c
  misc_feature (4404)..(4404): n equals a,t,g, or c
  misc_feature (4415)..(4415): n equals a,t,g, or c
  misc_feature (4421)..(4421): n equals a,t,g, or c
  misc_feature (4428)..(4428): n equals a,t,g, or c
  misc_feature (4438)..(4438): n equals a,t,g, or c
tttttcttagttcatattctttttcttttcttttctttattattatactttaagtttcagggtacatgtgcatattgtgcaggttagttacatatgtatacatgtgccattctggtgcgctgcacccactaactggtcatctagcattaggtatatctcccagtgctatccctcccccctccccccaccccactacagtccccagagtgtgatgttccccttcctgtgtccatgtgatctcattgttcaattcccacctatgagtgagaatatgcggcgtttggttttttgttcttgcgatagtttactgagaatgatgatttccaatttcatccatgtccctacaaaggacatgaactcatcatttttaatggctgcatagtgttccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttacccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttggtcaaagatcagatagttgtagatatgcagcattatttctgagggctctgttctgttccattgttctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtagcttgatggggatggcattgaatctgtaaattaccttgggcagtatggccattttcacgatattaattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacaatggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattaagagtttttagcatgaagggttgttgaattttgtcaaaggccctttctgcatctatgcagataatcatgtggtttttgtctttggctctgtttatatgctggattacatttattgatatgtgtatattgaaccagccttgcatcccagggatgaagcccacttgatcatggtggataagctttttgatgtgctgctggattcggtctgccagtattttattgagggtttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttccttcttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcgttggtttcaaagaacatctttatttctagcttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatctgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagactgtgtcttttaattggagcatttagtccatttacatgtaaagttaatattgttatgtgtgtatttgatcctgtcattatgatgttagctggttattttgctcgttagttgatgcagtttcttcctagnctnganngtctntacantttggcatgnttttgcagtgnctggtacnggttgttcctttccatgtttagtgcttccttnaggagctcttttagggcnggcctggtngtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagngtttctgcngagagatcnnctnttagtctgatnggcttncctttgngggtaacccnacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgccctgcccctagaggtggagcctacagaggcaggcaggcaggcctccttgagctgtggtgggctccacccagttcgagcttcctggctgctttgtttatctaagcaagcctgggcaatggggggcccccctcccccagcctcactgccgccttgcagtttgatctcagactgctgtgctagcaatcagcaagactcagtgggtgtgggaccctccaagccaggtgcgggatatagtctcgtggtgcgccgtgttttaagctcgtcagaaaagcgcagtattcgggtgggagtgacccgattttccaggtgccgtccgtcacccctttctttgactaggaaagggaactccctgacccctgtgcttcccgagtgatgcaatgcctcgccctgcttcggctcgcgcatggtgtgcacacccactgacctgcgcccactgtctggcactccctagtgagatgaacccggtacctcagatggaaatgccgaaatcacccgtcttctgcgtcgctcaggctgggagctgtagacgggagctgttcctattcggccatcttggctcctcccccccaggcacaatactttctaaaggcaccttgaagcctaaaagagcccttcttatactctgaggtatctcaccactgaaactggttacatacatctgtattgggaattaatggataagggtggaacaaatgaaatgcatttctgggggccagatattccaaagcagtttggggtagccttcttcctcctcctctgcaatgctttgttagttggaggctgtaaacatgccgatgctttcccaaatttgtgggaatgaatgtgaatcacagtttttggggcttcaatctcctctgcggacacataaaaaggaactttcatcaatttctaacaaggtttgagatctatgcctggatagagctggatattgatgcaaaagtaagaagcaaaagatgatttccttgagttccagcaatttcaataaaaaacacagagaccagacttgcaacaacactatagtgtcaaagagctggttcccaaaggggagcatagagtccacccataccagagacagacgagatctaacactttttgagtttaatattaatgttgcagcatggtaatgaaaactagtaaaagaatctctcttggtaaatgaatcttcactcccaaacggcaagcaggaaaaaccctaaataaataatgtgagattgatatcagaggcccatgtgcagggactcgattacaattcttggcttgtactcaggggccctcatgcattttttaagagctcatcaatattgtgatccttctgcttgctggtgaactttaaaaactacaccgaggtataaaagtagggctttgactttgttgaggcttatgattcttctcaaataaagtagatctgaataaaagacggattggaaaatcttccctggcctttaggcaagcacagaacttagcagtggttttggagcacccactatggaacgatccatgagatccaaagatggatacagttcccacacaacagccacaaggaaccacacattggggaccacctgaagcagaaccctagctgggggcttggccttgttctgccatgaagctgacagagctgtttctacaacaatgtgcatcttgaatcatcccacagaaggagctgagttaggctggaaatgagagaattccagacagagggaaggtatatttgtggagttgtaggaggccagaaagttgaaggctggagactaggggcaaggttggaggctggagaccaggggtcaaggcaaggaagacaaggctgacccctcagacgctagtaagtctctactgtgagagcagcaggaagccatggaagggggttaaacagaggaaggttgactcttactggaaatgatggcttgtctcccatttctggtttgggatacaggatgccttaggccctggtgccagcagagtgtacaggaggccacattggaagacgatggtctttgctgtcttcttacctttctgtatgctccctgggccttcgtgtggctttagcttctcacaaggcctcactgggctgtgtatgtgtgtgcgtgtttgtgtgtgtaggtggtgactgaccatcttctatgagctgggctttgtattatttcttgaccttctcaagatttgcctgtctcatgtcttcagaacccattgcctgcagtctttgatacacactattctgataaatgaatgagactgtgaggagtgttaatttaagatattaacccttttatgtgttagggtaatacccagtgtctttttactcaggagatattcaatcagtagggattcaatacacgagtgtcgtatatttgtgttttaaccgggtctgtctgagatgcagtgaacgttcagttagcctgggcagccttctttcttgtcatctgtagagctggaatctgggagcttccttctggtcactcagcagggacaaagaggcctctacccccacatcactgttctctaaggtacatgcctcccccatcactttccacctctcgaggaactggcacagcccaggatttcgcaatgattagaactgaaccccaataagctacccaagaaaaacagtgagccttttaaggggctcagaagtcagacaagagaatcagaacacagggaatacatgttctggaacaagaggacacaaacaccagcttagcaactgcagcaagtacagtgaaccagccagaccaccggacaaggtcagaggtacaggggatggcctcttgaacacagtggcaggaggatggttgcagggtagtggctgcagaagaccccatgtacatacatgctaagcttttatttcaggcaaagggcttagagttctaagcttgagaacccctcagaacaggtcctactgtcactttctgagtctgagggagagttactaagaagacactgaaattctataagagcccttaagaagctaaaattgcaaatactcctcagagagacctggatttccagcagaaatcaggattagcacatgccaatatttaggtcgacatcgagtgggcgtgaacagcagtatgtggaggctttgttggatggccccagggttcttttaacctaaaattctatgggagtgtttgaagggtcgtagttcagagggaactcttgatccctgttgtgaacgccaagctcattcctatctcctggcctttatctttgctcagctctctggaccaccagaaggatctttgcagggctccttccatcccatcatttacgtctcattgcctgagaggcctttccgggccattctttccaaaatactcccctcccacgttttatccccttcctggatttgcttctccacccagcactcaccacagtcgggaacgatactatttgtttgtttacttgatcagtggggatctctgtgggtcttgtctatcaatcactgcatcctcagttcccaaaacaggaccagtcatttagtgtccactcaacacacgcatggcaaaaaaagacagaggagcagggaggctgagagggagggagcaagccttcctctagaagggtggaacgcagagcagtgcagtgagaatgtgtgtgtgcctgtgtgtatccatgcatgggagcatgtgcttatgtatccacgtacatgtgcatgtgtgtcaacatatatgtgtccatgcatgtgtacttgtgtgtgaatgtgtatgtgtgcacgcatgtgtgtgcgcaagcacacgtgtaggcatcaaagagacttgcatttgaaaggagacccttagtataatatttatgataaacatttcaaaactgagttttagtgatgtgcagaacagaggaggaagatgcaagccccgaggcttggcaccccagctgcctgagccaagtcctcaggcagtgagggagatataggtaagtgaagctgggggtgggggttatttagctctgaagattggactgctggtgtcttgttttgatttcagagccaacatgacagatacccagacttcagagagggaaaacagcatggtcaaaatgacaactgagaatacggtggccagccttggtcagaatagtgctgacctgtgcagaggtaggctctttcttcaggtaagggctcctggcctctctgcatgccttggggcccgcctcctactctccaccctcacaccctcaggagagagtgatgcaagatgaatggatcctaaaattaaaatccagtaactctttcgaattactggcaatttagtgaattaacaagttggcaccaggcagtggccttttcccactaaaaaaaaaaaaaacaacctcaaatgcattccccaaggaaggggctgaaactcataaccttgtgtctggggcccagagggcatgagcacagagatccaaaggggctgatgctttccctaccactagtggggcaggctgtgttagggtgcatgtctgaaacttgaaactgaattaagtagcttcatgtaatggcttctcttgacggcacaggataaacatcataagaagaagaagcagtaatccaagaaggtttgcaactggctcaaaatgctacctgaaaccaagaattggaagccaccttgacccagaggaaaaaaaattgttaaactttgcagctatttctcaaaagaatagagaattttgttttctgtttgtagagatgggaatagtcatcccttatggaagaagacaataatttgctgcatttttaggacttgtaattgtacaggcaaattcaaaattcaggtagcattaaaattacagctagataatgctgcctgctttgtggatagctatcctcatttcaagggagagcacccctttatctgttgaagagatgtctttttgatttgctaagggcaagaatggaaaataagtgcgaataggaacagctccggtctgcagctcccagcgtgagcgacgcagaagacgggtgatctcggcatttccatctgaggtaccgggttcatctcactagggagtgccagacagtgggtgcgcacactgtgcgtgagccgaagcagagcgaggcattgcctcactcgggaagcacaaagggtcagggagttccctttcctagtcaaagaaaggggtgacggacggcacctggaaaatcgggtcactcccacccgaatactgtgcttttctgacgggcttaaaacatggcgcaccacgagattatatcccgcacctggcttggagggtcctacgcccatggagtctcgctgattgctagcagagcagtctgagatcaaactgcaaggtggcagccaggctgggggaggggggcccgccattgcccaggcttgcttaggtaaacaaagcagcctggaagctcgaactgggtggagcccaccacagctcaaggaggcctgcctgcctgcctctgtaggctgcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcactaccaggcctgccctaaaagagctcctgaaggaagcactaaacatggaaaggaacaaccggtaccagccactgcaaaatcatgccaaaatgtagagaccatcaagactaggaagaaactgcatcaactaacgagcaaaataaccagctaacatcataatgacaggatcaaatacacacataacaatattaactttacatgtaaatggactaaatgctccaattaaaagacacagactggcaaattggataaagaaagagtcaagacccatcagtgtgctgtattcaggagacccatctcacgtgcagagacacacataggctcaaaataaaaggatggaggaagatctaccaagcaaatggaaaacaaaaaaaggcaggggttgcaatcctagtctcggataaaacagactttaagccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcatcaagtggacctaatagacatctacagaactctccaccccaaatcaacagaatacacatttttttcagcaccacaccacacctattccaaaattgaccacatacttggaagtaaagctctcctcagcaaatgtaaaagaacagaaattataacaaactgtctctcagaccacaggtcaatcaaactagatctcaggattaagaatctcactcaaaatcgctcaactacatggaaactgaacaacctgctcctgaatgactactgggtacataacgaaatgaaaccagaaataaagatgttctttgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaaccgaagcaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagagtactacaaacacctctacgcaaataaactagaaaatctagaagaaatggataaattcctcgacacatacactctcccaagactaaaccaggaagaagttgaatctctgaatagaccaataacaggatctgaaattgtggcaacaatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagataattttagaccaatatccttgatgaacattgatgcaaaaatcctcaataaaatactggcagaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagtcaaattgtccctgtttgcagatgacatgattgtgtatctagaaaaccccactgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaatcaatatcgtgaaaatggccatactgcccaaggtaatttacagattcagtgccatccccatcaaggtaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgaccaacctgagaaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggacctagaactagaaataccatttgacccagccatcccattactgggtatatacccaaaggaatataaatcatgctgctataaagacatatgcacacgtatgtttattgcggcattattcacaatagcaaagacttggaaccaacccaaatgtccaacaatgattggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaacatcacactctggggactgtagtggggtggggggaggggagagggatagcactgggagatatacctaatgctagatgactagttaatgggtgcagcacaccagcatggcacatgtatacatatgtaactaacctgcacaatatgcacatgtaccctaaaacttaaaataataaaagaaaaaaagaaaagaaaa

SEQ ID NO: 12500 - DNA, 5536 bp, Homo sapiens
atttttttttaaattttattattattatactttaagttttagggtacatgtgcacaatgtgcaggtttgttacatatgtatacatgtgccatgttggtgtgctgcacccattaactcgtcatttagcattagatatatctcctaacgctatccctccccctcccccaaccccacaaccatccccagagtgtgatgttccccttcctgtgtccatgtgttctcattgttcagttcccacctatgagggagaacatgcggtgtttggttttttgtccttgctgtagtttgctgagaatgatggtttccagcttcatccatgtccctacaaaggacatgagctcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcgtgatttataatcctctgggtatatacccagtaatgggatggctgggtcaaatggtatttctacttctagatccctgaggaatcgccacactgacttccacaatggttgaactagtttacagtcccaccaacagtgtaagtgttgctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgcttttttcttgtaaatttgtttgagttcattgtagattctggatattagccctttgtcagatgagtaggttgaaaaaattttctcccattctgtaggttgcctgttcactctgatgatagtttcttttgctgtgcagaagccccatagtttaattagatcccatttgtcaattttgccttttgttgtcattgcttttggtgttttagacatgaagtccttgcccatgcctatgtcctgaatggtattgcctaggttttcttctagggtttttatggttttaggtctaacatataagtctttaatccatcttgaattaatctttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttggttccatatgaagtttaaattagttttttccaattctgtgaagaaagtcattggtagcttgattgggatggcattgaatctataaattaccttgggcagtatggccattttcatgatattgattcttcctacccatgagcatggaatgttcttccatgtgtttgtatcctcttttatttcattgagcagtggtttgtagttctccttgaagaggtccttcacattccttgtaagttggattcgtaggtattttattctctttgaagcaattgtgaatgggagttcactcatgatttggctctctgtttgtctgttattggtgtataagaatgcttgtgatttttgcacattgattttgtatcctgagactttgctgaagttgcttatcggcttaaggagattttgggctgagacgatgaggttttctagatatataatcatgtcatctgtaaacagggacaatttgacttcctcttttcctaattggatgccctttatttccttctcctgcctgattgccctggctagaacttccaacactatgttgaataggagtggtgagagagggcatccctgtcttgtgccagttttcaaagggaatgcttccagtttttgtccattcagtatgatattggctgtgggtctgtcatagatagctcttattattttgagatacaacccatcaatacctaatatattgagagtttttagcatgaagggttgttgaattttgtcaaaggccttttctgcatctattgagataatcgtgtggtttttgtctttggttctgtttatatgctggattacatttattgattttcgtatgttgaaccagccttgcatcccagggatgaagcctacttgatcatggtggataagctttttgatgtactgctggattcggtttgccagtattgtattgaggatttttgcatcaatgttcatcaaggatattggtctaaaattctctttttttgttgtgtctctgccaggctttggtatcaggatgatgctggcctcataagatgagttagggaggattccctctttttctattgattggaataatttcagaaggaatggtaccagctcctccttgtacctctggtagaattcggctgtgaatccatctggtcctggactctttttggttggtaagctattaattattgcctcaatttcagagcctgttattggtctattcagggattcaacttcttcctggtttagtcttgggatggtgtatgtgtcgaggaatttatccatttcttctagattttctagtttattttcgtagagttgtttatagtattctctgatggtagtttgtatttctgtgggatcggtggtgatatcccctttatcattttttattgcatctatttgattcttctctcttttcttctttattagtcttgctagtggtctatcaattttgttgatcttttcaaaaaaccagctcctggattcattgattttttgaagggttttttgtgtctctatttccttcagttctgctccgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatatgtcccagagattgtggtgtgttgtgtctttgttctcattggtttcagagaacatctttatttctgccttcatttcgttatgtacccagtagtcattctggagcaggttgttcagtttccatatagttgagcagttttgagtgagtttcttaatcctgagttctagtttgattacactgtggtctgagagacagtttgttataatttctgttttttcacatttgctgaggagtgctttacttccaactatgtggtcaattttggaataggtgtggtgtgctgctgaaaagaatgtatattctgttgatttggggtggagagttctgtagatgtctattaggtctgcttggtgcagagctgagttcaattcctggatatcctttttaactttctgtcttattgatctgtctaatattgacagttgggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcgttctttgtctcttttgatctttgttggtttaaagactgtttcatcagagactaggattgcaacccctgcctttttttgttttccatttgcttggtagatcttcctccatccctttaatttgagcctatgtgtgtctctgcacgtgagatgggtttcctgaatacagcacgctgatgggtcttgactctttatccagtttgtcagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggagctcttttagggcaggcctgttggtgacaaaatctctcagcatttgcttgtctgtaaagtattttatttctccttcacttatgaagcttagtttggctggatatgaaaattctgggttgaaaattcttttctttaagaatgttgaatattggtccccactctcttctggcttgtagagtttctgccgagatcagctgttagtccgatgggcttccctttgtgggtaacccaacttttgtctctggctgcccttttaacattttttccttcatttcaactttggtgaatctgacaattatgtgtcttggagttgctcttcttgaggagtatctttgtggcgttctctgtatttcctgaatttgaatgttggcctgccttgctagattggggaagttctcctggataatatcctgcagaatgttttccaacttggttccattctccccgtcactttcaggtacaccaatcagacatagatttggtcttttcacatagtcccctatttcttggaggctttgtccatttctttttattcttttttctctaaacttctcttctcgcttcatttcattcatttcgtcttccatcactgataccctttcttccagttggtcacatcagctactgaggcttgtgcattcgtcatgtagttctcgtgccatggttttcagctccatcaggtcctttaaggacttctctgcattggttattctagttagccattcgtctaattttttttcaaggtttttaacttctttgccattggttcgaacttcctcctttagctcggagtagtttgatcttctgaagccttcttctctcaacgcgtcaaagtcattctccttccagttttgttccattgctggtgaggagctgcgttcctttggaggaggagaggcactctgatttttagagtttccagtttttctgctctgttttttccccatctttgtggttgtatctacctttggtctttgatgatggtgacgtatagatgggtttttggtgtggatgtcctttctgtttgttagttttccttctaacagtcaggaccctcagctacaggtctgttggagtttgctggaggtccactccagacgctgtttgcctgggtatcagcagcagtggctgcagaacaacggatattggtgaaccgtaaatgctgctgcctgatcgttcctctggaagttttgtctcagaggagtacccggctgtgtgaggtgtcagtctgcccctactggggggtgcctcccatttgggctactcgggggtcagggacccacttaaggaggcagtctgcccgttctcagatctcaagctgcatgctgggagaaccactactctcttca

SEQ ID NO: 12501 - DNA, 5129 bp, Homo sapiens
aaattttttttttattatactttaagttttagggtacatgtgcacaatgtgcaggttagttacatatgtatacatgtgccatgctggtgtgctgcacccattaactcgtcatttagcattaggcatatctcccaatgctatccctccccccaccccaccccacaacagtccccagagtgtgatgttccccttcctgtgtccatgtgttctcattgttcaattcccacctatgagtgagaacatgtggtgtttggttttttctccttgcgatagtttactgagaatgatgatttccaatttcatccatgtccctacaaaggacatgaactcaccattttttatggctgcatagtattccatggtgtatatgtgccacattttcttaatccagtctatcactgttggacatttgggttggttccaagtctttgctattgtgaatagtgccacaataaacatacatgtgcatgtgtctttatagcagcatgatttatagtcctttaggtatatacccagtaatgggatggctgggtcaaatggtatttctagttctagatccctgaggaatcgccacactgacttccacaatggttgaactagtttacggtcccaccaacagtgtaaaagtgttcctatttctccacatcctctcctgcacctgttgtttcctgactttttaatgattgccattctacctggtgtgagatggtatctcattgtggttttgatttgcatttctctgatggccagtgataatgagcattttttcatgtgttttttggctgtataaatgtctcctttggagaactgtctgttcatgtccttcgcccactttttgatggggttgtttgtttttttcttgtaaatttgtttgagttcattgtagattctggatattagccctttgtcagatgagtaggttgcgaaaattttctcccattctgcaggttgcctgttcactctgatggtagtttcttttgctgtgcagaagctctttagtttaattagatcccatttgtcaatttggtgccaaaacaccaacaccattgcttttggtgttttagacatgaagtccttgcccgtgcctatgtcctgaatggtaatgcctaggttttcttctacggtttttatggttttaggtctaacgtttaagtctttaatccatcttgaattaatttgtgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcgttatttctgagagctcttttctattccatttatctatatctctgttttggtaccagtatcatgctattttggttactgtagccttgtagtatagtttgaagtcaggtagcgtgatgcctccagctttgttcttttggctgaggattgacttggcgatgcaggctcttttttggttccatatgaactttaaagtagttttttccaattctgtgaagaaggtcattggtagcttgatggggatggcattgaatctataaattaccttgggcagtatggccattttcacgatattgattcttcctacccatgagcatggaatgttcttccatttgtttctatactttttatttcattaagcagtggtttgtagttctccttgaagaggttcttcacgtcccttgtaagttagattcctaggtattttattctctttgaagcaattgtgaatgggagttcactcatgatttggctctctgtttgtctgttattggtgtataagaatgcttgtgatttttgcacattgattttgtatcctgagactgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctagcctgaaattccaacactatgttgaataggagtggtgagagagggcatccctgtcttgtgccagttttcaaagggaatgcttccagtttttgcccattcagtatgatattggctgtgggttcgtcataaatagctcttattattttgtgatatgtcccatcaatacctaatttattgagagattttagcatgaagagttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataacgtttttgatgtgctgctggatttggtttgccaatattttattgaggatttttgcatcaatgttcatcaaggatattggtctaaaattctcatttttggttgtgtctctgcccggctttggtatcaggatgatgctggcctcataaaatgagttagggaggattccttctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagagtcagcttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgattcttctcttttttcttctttattagttttgctagcggtctatcaattttgttgatccttcaaaaaaccagctcctggattcgttaattttttgaagggttttttgtgtctctatttccttcagttctgctctgattttagttatttcttgccttctgctagcttttcaatgtgtttgctctagcttttctagttcttttaattgtgatattagggtgtcaattttggatctttcctgctttctcttgtgggcatttaatgctataaatttccctctacacactgctttgaatgtgtcccagagattctggtatgttgtgtctttgttcttgttggtttcaaagaacatctttatttctgccttcattttgttatgtacccagaagtcattcaggagcaggttgttcagttaccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctcaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctctcattattattgtgtgggagtctaagtctctttgtaggtcactcaggacttgctttatgaatctgggtgctcccgtattgggtgcatatatatttaggatagttagctcttcttgttgaattgatccctttaccattatgtaatggccttctttgtctcttttgatctttgttggtttaaggtctgttttatcagagactaggattgcaacccctgcctttttttgttttccatttgcttggtagatcttcctccatccttttattttgagcctatttgtgtgtgtgcacgtgagatgggtttcctgaatacagcacactgatgggtcttgactctttatccaatttgccagtttgtgtcttttaattggagcatttagtccatttacatttaaagttaatattgttatgtgtgaatttgatcctgtcattatgatgttagctggttattttgctcgttagttgatgcagtttcttcctagcctcgatgatctttacaatttggcatgattttgcagtagctggtaccggttgttcctttccatatttagcgcttccttcaggagctcttttagggcaggcctggtggtgacaaaatctctcagcatttgcttgtctgtaaaggattttatttatccttcacttatgaagcttagtttggctggatatgaaattctgggttgaaaattcttttctttaataatgttgaatattggcccccactctcttctggcttgtagagtttctgccaagagatctgctgttagtctgatgggcttccctttgtgggcaacccgacctttctctctggctgcccttaacattttttccttcatttcaactttggtgaatctgacaattacgtgtcttggagttgctcttctcaaagagtatctttgtggcactctctgtatttcctgaatctgaatgttggcctgccttgctagattggggaagttctggataatatcctgcagagtgttttccaacttggttccattctccttgtgactttcaggtacaccaatcagacgtagatttggtcttctcacatagtcccatatttcttggaggctttgttcatttctgtttattcatttttctctaaacttcccttcttgcttcatttcattcatttcatcttccatcgctgataccctttcttccagttgatcgcaacggctcctgaggcttctgcattcttcacgtagttctcgagccttggctttcagctccatcagctcctttaagcacttctctgtattggttattctagttatacattcgtctaaatttttttcaaagtttttaacttctttgcctttggtttgaatttcctcctgtagctcagagtagtttgatcatctgaagccttcttctctcaactcgtcaaagtcattctccatccaggtttgttccgttgctggtgaggaactgcattcctttggaggaggagaggcactctgctttttagagtttccagtttttctgccctgttttttccccatctttgt

SEQ ID NO: 12502 - DNA, 6066 bp, Homo sapiens
tttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctcc

SEQ ID NO: 12503 - DNA, 20421 bp, Homo sapiens
tggatatccttgttaaccttctgtcttgctgatctgtctaatattgacagtggggtgttaaagtctcccattattattgtgtgggagtctaagtctctttgtagatctctaaggacttcctttatgaatctgtgtgctcctgtattgggtgcatttatatttaggatagttagttcttcttgttgaatcgatccctttaccattatgtaatggccttctttgtctcttttgatctttgttggtttaaagtctgttttatcagagactaggattgcgacccctgcctttttttgttttccatttgcttggtagatcttcctccatccctttattttgagcctatgtgtgtctctgcacgtgagatgggtttcctgaacacagcacactgatgggtcttgactctttatccaatttgccagtctgtgccttttaattggagcatttagcccatttacatttaaggttagtattgttatgtgtgaatgtgatcctgtcattatgatgttagctggctattttgctcgttagttgatgcattttcttcctagcttcgatgctctttacaacttggcatgtttttgcagtggctggtacaagttgttcccttccatgtttagtgcttccttcaggagctcttttagggcaggcctggtggtaacaaaatctctcagcatttgcttgtctgtgaagtattttatttctccttcacttatgaagcttagtttggctggatatgaaattctgggttgaaaattcttttctttaagaatgttgaatattgcccctcagtctcctctggcttgtaggtttttggccaagagattcgctgttagtctgatgggcttccctttgtgagtaccctgacctttctctctggctgcccttaacattttttccttcatttcaaccttggtgaatctgacagttatgtgtcttggggttgctcttctcaaggagtatctttgtggtattctctgtatttcctgaatttgaatgttggcctgccttgctaggttggggaagttctcctggataataccctgaagagtgttttctaacttggatccattctccccatcactttcaggaataccaatcaaacatagatgtggtcttttcacatagttccacatttcttggaggctttgttcatttcttttcactctttttgctctaatcttgtcttctcgctttatttcattcatttgatcttcaatcactgatgtcctttcttccacttgattgaatcggttattgaagcttgtgcatgtgtcacaaagttcttgtgctgtggttttcagctccatcaggtcatttaaggtcatctctacactgtttattctagttagccatttgtctaacctttcttcaaggtttttagcttccttgcaattggttagaacacgctcctttagctcggagaagtttgttattaccgaccttctgaagcctacttctgtcaacttgtcaaactcattctccgtctagttttgttcctttgctggcgaggatctgcaatcctttagaggagaagagacgctctggtttttggaattttcagcttttctgctctggtttctccccctctttgtggttttatctacgtttggtttttgatgttggtgacctacagatggggttttggtgtggatgtgctttttgttgatattgatgctattcctttcggtttgttagttttccttctaacagttgggcctctcagatgcaggtcttttggaatttgctggaggtctactccagaccctgtttgcctgggtatcaccagcagaggctgcagaacagcaaatattgctgcctgattctttctctgggagcttcgtcccagaggggtacctgcctgtatgaggtgtctgtcagcccttactgggaggtagctcccagtcaggctacacaggggtcagggacccacttgaggaggcagtctgttcattctcagagctcaaacaccatgctgggagaaccactgctctcttcagagctgtcagacagggacgtttaggtctgctgaagctgtctgctgccttttgttctgatatgccctgcccacagaggtggaatctacagcaaggcagcaggccttgctgagctgtggtgggctctgtcctatttgagcttcccagcctctttgtttacactgtgagcataaaaccgcctactcaagcttcagcaatggcggacaaccctccccttgccatgctgcagcatcgcaggtcaatctcagactgctacggtagcagtgagcaaggctccgtgggcgtgggacccgccaagccaggcacgggagggaatttcctggtctgcctgttgcaaagactgtgggaaaagcgcagtatttgggcaggagtgtaccgttcctccaggtatagactgtcacagcttcccttggctagaaaagggaaatcctccaacccttgtgcttctctggtgaggcgacgccccgtcctgcttccgcttgccctccatgggctgcacgcactgtccaaccagtccaaatgagatgaaccaggtacctcagttggaaatgcagaaatcacccatcttctgcatcagtcttgctgggagctgcagaccagagctgttcctatttggccatcttggaagccagacctaaatcctctctctctttttgtttttaactgaacttctgatatacagaattggattaaacataatccttagttgtaatacactgtcatctttggtcccatgcatagccctctttaattctaatttccttatttatgtatttacccctttataatttaatgcatacccatgaatctaccaccctacccagtgcctagaacattgataatcaagcacctctgtgccccttgtgttgtctccgccaatctgcacccttgctgaaaggcaaccactctcagaattttgtgcttattattcctttgctcttttccttatagattttttgtacacagatgtgtgcctcaataatgccttgtttcattttagttgttctgcaacttcctaaattacttactcctatgccagtaccactcaatgtcattgctacagtgttaagtaacctgatatctggtagacaagtcctgctgtccccaaattcctcattcctttttagaaggagatgccacggggaattggggacccattcctgaggacttcaccctgccctggatgaaattagcaccaactgtctctgcaagcacccttctgcttcccctgcctggtctctgatattggatgtgtttctttcagtacccataggggcagctgggttgttccagtgctgcagtgacagggaacactgcagaggttgggaagatccgtggagcagggtgcatgccaacccagaggcacccccacctgacactctccccatgtgacaagggctgtcccatccaaggccagcatgtccaaccattgtgcagctccctggggcaggttccaagttaaacacagtcagactttctgggacaattttaagctgagttaggagtatcctctaccagaccaaggaactggtgctgtgtgttactaattctgtctgcctgcaggaccttgccaggcttcttcagtggactcagggcaatatgaaagagctactttttattcattacctgcatcagaggacctgggctgcattttcctttgtagagatgcaggctcatttcagctgcctcctctctcccgaacactgggtttctcattctcattgacccagaacctacaatatccaaagcagagcggtaagggctggacagctaacacgagacccagccctgcctgtgggagcccataggggtgaggacagctccagcaacagggaacagttctacagagattcagggtggtcagggatttcctgaagtttgagggcagggagaccatatttcccaaaccccaaattaggacaatgaggtctggcagcaggacagaatatttcaaaccaggatcgtctcataaaactctcaggtttagtcaccgtaatgatgagaaccactcacaggcctctgcctaggagggtctgatgaggatgtggagaagggctcacagcagcaggtgtgagctgtgtttcatggggacagggaagggcaaggagacctagggaggctgcgttcataatggagtcaggaagatagaaaggatgggacaaagagatgtttaggacgtggacatgaaagcacttgggggtagattgggcttggagagcagaggagggacattgtgagtgtgtctgaagatctcagcctggtaacatggctacaaagacagggctcccactagagaagtacagcagtaaggaggaagggcagggaacttggtttcactgcggagagttgacatgtctatgaggccacagacagggcatgtggaccagtgtattagaatcactcagatcatgttaaaatgttgcttctgatgcagtaggtcagggtggagcacaagatcctgcattttcaacaggctcccaggtgacactggtgctgccagtccacagatcacgtagccaggctaacgagggtcccagacaagaatcgggcagagatcacatgtgacaatgtccctaatttggataaggagttaagtacatgttgaattgaggcatgtagtgtcatttttcatttccccccacaagaaaaatgtctcgacttccaggaaaaccattatcgatcaccctgattagaatccagggatgcaaaaatggaaggggagatgtgcctttatataatttttttcatatgaagaactgattcctctaactttcacaggtatgactttggttgtaagcagttgagcagagcgatatttttctttctgcctctttggaagtgaattttctgatgaggttagctccttctctccgtttcacccatgcgctcaccagcacaaggtggcagggtctgcaatcagacaggaagtggctggtgttgcagtaatattagagtcagggcagctctgtgccttcatcacatcatggcaggggaagaatcagaaggttcagaaccctgaagaccaggactcccatgcctcctcctcataatacctggactcaggtgttctcaggcatatccattagtatgaattgaagtcaacatgtgccccctgccaggggtcagtctcattctgagacctcagtctgcctgcagaaataagcagtgaatggatttcaggcatgggcccaaggttcagggggatgtatgtggttcctctgagaataaggaggctgtgtcctgcccagggttgtctctgcagacacctcctccctctgcttatattcagggaagggttgcaattcagctcctgcatattgggctcattttgaactttaatgacaccaaaaacaaaacagttgactttgtgacttggtttcctttgggagtttaaataaatattactatagaaatatcattctccttgtccaaggcttctcttctaagaggtgtgaagatagaggagaatcatattggatcctagcctttcctctatggcttgtggagattttgtgggaaggccagtcaaacatatgggtgccccacgcagacaggtttgaaagacctacctgagaagggggttctggttacatccttgccaccccaccaaatgctccccaagtctttggggctctatgattcaccacaagagagtgagccccagcatttcagaactgaccagatgcttagagaaaatctcattcagtggcctcagacaggaaagagaagctcagagagggaagaaatgtagcatcccaaggggttaatggaagaactgaggctcaaacccctgtctcctgaacccagtcacctctgcctccacctccctgccttccttggcctgaggagtggcattcactgcagcagcccaggtcccagccagcctttcatccctgaggccctgggctcaggagatctcagactcaatcctgaggagagaagacggagcagcctgttggaatggaagctgaccccaagtccacgtccacagagatcaaggctcctggatccgagtccagtcctctgtttttctcccactttccttcaatttccaaccggggttccaggcttgctaccaacatcccaagagtgatatttttcgaaggacaccatctgcccattgtatcaaccccagaggatcttcttccacagacccagggagaccaaataacaacagcaaaccaaatatcgatggcatctgagcatgtgccaggccatgctttaatcctttccgtaggttacctcctttaattcgcacaagcaccgtcagagacaggtccacgagctgagtttgctaggaccttggctgggataggacttgaattcctctgtgaaaatagagcccactccgaccccttccatggatagattagtagtggatctgcctctgcttttgatggtaagaggctagtgaaagattctggcttgggccttacactagggtggagactgagctaggattcgcctccaatacagccccccatgccccagcccgggctctcaaaggctgggcaagggatgggaccttcttccacctcttcactccccgcccaacccaaacacacagaggtttctccaaggtgtgtatgcttcgaggtcaagaagacccaacagtggtccaggacacaaaccccagtaggacctgagtctccagtgcctgcctgaagccagtcattcttcctcacagctgggagggggtcaatagtgaacacccatgtggctcagcagggctggggggtgcagcagcaagccagcagtggacaggcagctgagcactgctgaactgttggccaggaaggcagagacctgtggaaggaaggccaccagagaagggttcaggtctccagaccccttgttcttttgacagtgctagtgtgagcccatggctaaaatgagcctcacctgtaaagctgagtgaggcctcagttcagccagtcctgcctttgataataacagcagcttagagccagccctgcccttgggcctggttcagccccacctccccgaggaaacctgcctggcctctgtccagagctcagaagccacatccccaggtctgcaaggctcctctaacatttatctcacaggcatcacttgccttgccattcactttttcatgtgcattttttttttctatcaaatctaatttgatttggtacagtcaaggccctttcactgccaggattaaatgtgatttctgttctgccaaacgtcaaccggtggagaggagcctcagccatcacgccaagccatttgccactctgatggagacacaggctggagaaggaaggcgaggccactctgccagctggtggctgagacttgccaggcacccagggctcccagctgcctagctgcatggcaggtcagggaaaggaggacaaatattctcttaggccctgcagtagaactgaggtctaagaactgagaaccgaaccgaattccagaagctctttgttcccagttcatttcctagtccttagccctgcccctcccacagtccctcactggctgccccattggcctgcctgacctcatacccttggttcctgggaatagtgaattgttcaactggatgaggagggaggagaagaaaaagaaggctggtgggtggagcagatctgaagagacggccctgcggcctccaggtttccctgaggggaaataatggttaagtcggtggggaagggggtggagtgtggtaagtcattggtcagagactggggtgcagaaatgggtttaggagtaatgctgaggttgatagtggcccaggtaatagtggctggatggaggagagagtccctgaggatctggcagtcaagaatcaggagcctgagtgatgagaaagtgatccctgtggaggagtcatcagggcgtgacaggtgtgggtggagaggggctgtggggggccaggccaaagccctgacaaacactgggccagtggtcagtggatgacagcatcaaggagtggggagaggactgagccaagtggtgtagtggtgtgaaccacacaggaagggggatttctcacaaacagaaggtgggtgtggagctttgtatatggcagaggagccaggaggggccctgccctgcctccaggcctgagtgagcacgcagcccccagagaaggtggaagggcaacggggtgccggcacagaatgcttggtccagttgaggcagctggggggagctcacagaaggagctggggttgcagttttctgtatgtggagtggcagttccaaagggtgtagtggaagatttgagtggtagggaagctgagggctggagtcagaggtaagggggacagagcatcatggggggatggctctttagcaaagtcagcttctagaaagaggttctactaagcatcaggatccaacagaactttaaattgttccattctaccttccttcacttcagggtgtcattcactctcctctttttctggaggtgggtaccatcctgtttctagggctcctttttcattttgctggaatgcctccttgagtaactttcagactaggtggacagaagctcttctttcagagccactgcacacatccaaaaaggaagctgctgtttgctctgcaacagtgtagctccctttagcctgggagggtgaggagtctttgggtgaaaatattttgccagacacactctcctgtcagtactgagtcagggagctgatgggaaggccagacccttgagttcttcatctaagtggaggtgtctttcccacacatcctgcccacctctgctgtggaggttttgcccatgctctattcagcttctctattggaccttcacagctccaggagcctctcccaaaggctgccctgctcaaacagagctggatcaggctctgcagctggggcagacaggaacacaactgtcccagatgttgggattacagttctttaaggattaccctatgtttgctccttggagcttggggtttctctgggactcttttggtgagagccctgcacatccctggtatacaaggctactggtctcgttgcttgatttctccaccatcctgttgcacctgcttcctgtcttcctggaatttaccataatgtctggctgctgatggcctttcttgttttccagcactcttatcctgtccctcatgcacacgcatgcacacatgagcgaatcttctgtcatttcagagagacgctgggtaggaggggtgcagtgtgtgggcccaggctgcccccttgatcacactgcctttgtctttggaacagccccacacggttcagctggaacattcgaatggaatttttcaagcactccctgttctgggttgtcccctttggaggcttctcacatccttgctttgcagcgttgctagggaaggccatgcattatttaggactattttcctgtgcaacactcctctgcacaagaagtaacttgatagctccgtatcccagggaaaatgagggccccacctgggctgtggggaccatctgtgtggatgacgcttgttggcacagagttcatctgaagatgctgcttgtgtcccagctgtagtcacaaccctttttgctggggaaacagtgaagcttgtcaacagaaaacgctccaaattccaaatgcttcctagatgggagctgaggtctctgttggccatgacagggccagtcggtacagggatgccatattttagaagtagcattactacaggtaatgatacacttgacaatttgcatgattaagtggattgacacctaacagatgcagaccctgagggcagaggagccaagtcattgaggaagagatgacacttgatttgagtccagaaagatgaggcatgttcctggcaggaagtacaaggaatggtgttctaggaaaaaggagcagcatgaggggagtctcaggggcatgaaagcaattctgaggcttcggacaccaaaaccatagtctgtggataactgatgagcacagtgtctgccacagagtgtgtgtgtgcttgcacatgtgtgtgtctcctcctcatttcattccctgaaaacaaacagtgctcaggtctatttgagttcagctttcagggctgtcactcaaaccctcccctatctgccgaccattgtctaaaattacaagagaatttcacctcttgactctaagatgctgatcttttttcaaaatataaatacagggttggggtagggtagtgacttgtgtcttggcatcttctcactgcaggcagagaagacttcagagggcccagggaagcagcttaagccaccaatctctgcaccaagatctccacccatttccatcacagaaacaggccatcataactggatgcaataactttccccattttattgatagctaaacagagtccctgggaagtccaatggctcacctagggttgtgcaggtggtcagtgatggaaaattaaggaatattcagatcactggagaacttttgaaatgattaccttgtcatatttttagcacagaaccagacatccatccctggctccaggaaatcttcatcaagagcagaacattgttgtcaattaggatgatgtactgaggcatttgtagaaccacaataagtaaattatgactatttttaagggtgcttcctgggctgatggcctgaaataagacacattttagagagaacacctttaaggcaaggggcctgttacgtcataccatcatcacaacagcccatagatggaggtgttgctatccccattttacagatgataaaaatgtggagccacatttttctcctctattaaatgggtgttgggagcagaaactaggattccaagccagctccttccccctactttttcccattagggcaggcaggcaaatgcttcacttgtgttgcgtctcaccaagtacttctgtcagtgattttttttaatgtaaacttatttttgaagtataagatatatgtagacagcacacaaatcttaagggtgctgcttgatgatgtttacaaacaacatgctagtagaaccagaactcaattcaagcagcagaaaattccagcccccccttcccaacccccaggaatccctcatgcctcctccccatcactactcccttaaggtcacctctgccctaacttcatcaccttgcttttgcttctatacagaagacgtcacacaaaatgtactttttctcactcaaagttatgtcgaaagattcctccatgcttttacatataattgtggttccttcattctcgtggctgattagtgttctatatgaagttacacaatttatttttacattccactgttgatggacagtagaattgttgctttcagtttggtgctgttacaagtaatgctcctatgagcatttgtgaatgaacattttggtgaacatgtatatgcttttctgttaggtgtttacccaggagattcagcagttttagtcaatgtggctagttttccaaagtggttgtgcagttcacgttgccactaaaagcattgtgagcattctggttgctctacatcctcatcagcacttaatactatctttttcattttagtcattctttttttttctttcctaatttcaagtttttggtttcttaatttcaacaggtggtttttgatttcatggaaaaagtctttagtggtgatttatgaaattttgatgcactactcaatgtgtagtcttttatccctcaaccccctcccaccctttcccccaggtccctaaagtccattatatctttgtttttttttttgagatggagtctcactcggttgccctggccaaagtgcagtggcacgatctcggctcactgcaacctccgcctcccgggttcaagctattcttctgcctcagcttcccgagtagctgggactacaggtgagcaccaccatgcctggctaatttttgtatttttagtagagacagggtttcaccatattggccaggctggtctcaaactcctgacctcgtgatccacccgcctcggcaccccaaactgctgggattacaggcgtgagccaccgtacccagcttttatgtcgttcttatgactttgcatcctcataccttagctctcatttataagtgagaacatagatgtttggttttccattcctgagttacttctcttagaataatggtctgcaacttcatccaggttgctgtgaatgccattatttcattccttttttatggctgagtagtattccaaggtgtgtgtatatatatatatatatattatcatatttggtttatccactcattcattgatgggcatttaggctgtttccataattttataactgtgaattgtgctgctataaacatgcatgtgcaactgtcttgttcatataataacttattttcctctgggtagatacctagtagtgagattgctagatcaaacagtagttctacttttagttctttaaggaatctccacactgttttccataatggttgtactggtttacattcccaccagcagtgtaaaagtgttccattttcaccacatctacacaaacatctgctattttttgacgtctgttatttcttaaattatggccattcttgcaggagtaagtatttcattgtggttttaatttgcatttccctgataattagtgatgttgagcattttgtcatatgtttgtcagccatttgtatatcttcttttgagaattttctattcatatcctttgcctactttttgatggattatttgtttttttcttgctgatttgcttgagttccttgtagattctggatattagtcctttgtcagatgcatagtttgtgaatattttctcccactctgtgtttactctgctgattattttgctgagcagaaactttttagtttaattaggtcccatctacttatctttgtttttattgcatttgcttttaggttcttggtcatgaactttttgcctaagccaatgtctagaagagtttttcctgttatcttctagaatttttatggtttcaggtcttagatttaagtttttgacccatcttgaggtgatttttgtataagatgagagatgaggatccagcttcattcttcaacatgtgacttgtcaaatcccagcaccatttgttgaataggttgtccttttcccactttatgtttttgtttgcttggtcaaagatcagttggctgtgggtatttggctttatctctgggttctctattctggtccattggtctacatgcctatttttataccagtaccatgctgttttggtaactatagccttgtagtataaagttgggtaatatgatgcctccagatttgttctttttgtttagtcttgcttaggctatgtgagctctttttcagtttcatatgaattttaggattgttttctcttgttttgtgaagaatgataatggtattttgatgggaattgcattgaatttgtagattgcttttggcagtatggtcatcttcacaatattgattctacccatccatgagcttgttttgtgtcatctatgaattctttcagcaatgtttggtagttttccctgtggaaatctttcacctccttcattaggtatattcctaagtatttttcctttttttttttcttttctttttttttttttcttttttctttttttttttttttttttgcagctgttgtaaaagggattgagttcttgatttgattctggtcactgttggtgtatagcagtgctactgatttgtgtacattgattttgtatactgaaacttaactgaattcatttatcagatcaaggagctttttagatgagtctttagggttttctaggtatacagtcatatcatcggcaaatagcaacagtttgacttcctctttacagatttagatgccctttgtttatttctcttgtctgactgttctggctaggacttccagcatatactgttgaatagcagtggtgaaagtgggcatccttgtctcgttctagttctcagggggaatgctttcaacttttccccattcagtagtttaatgttggcatgggtctgtaatagatggcttttattaccttaagatatgtcccttctatgccaattttgctgaggcttttaatcataaagggatgctggattttgtcacgttttttctgcatctattgacatgcttatatgatttttgtttttaattatgtttatgtgatgtatcacatttattgacttttatatgttaaaccatccctgcatgcctggtgtgaaacctgcttgatcatggttaattatcttttttgatatgctgccgaattcagttagctagtattttgttgaagatttttgcatgtatgttaattagggatattggtctgtagttttcgttttttgttatgtcctttcccggttttggtattagggtgatactggcttcatagaataatttaaggaggattccctctttctctatcttttggaatagtttctttttttttttttgcagcaatatatcaatttaatttgtaaatgaggtataacaggtacactgcaaaagatatataagcatactgttcagtgaattcttaagtatatacacatgtaatcaccactcagatcaatacatagattcccagcactggaacagggctctcttatctttaatgtcaatagcaccaacaaccccagccccaccatctcacccccaagtaaccactattctcacttccatcaccatagattagttttgtctgtttctgaattttgtataagttgagtaaaatataattgttgtatgattctttttactttatattatatatgatttataagatcagttatgtatagtagaagtttttgttttgtgtggcattgcattgtattaatataccgtaatttatttatctactctctgatgtacatttgggtcacttccagtttttcttttattattattattattattattataccttaagttttagtatacatgtgcacaacgtgcaggtttgttacatatgtatacatgtgccatgttggtgtgctgcacccattaactcatcatttagcattaggtatatctcctaatgatatcccccctccccccaccccacaccagtccccggtgtgtgatgttccccttcctgtgtccatgtgttctcattgttcaattcccacctatgagtgagaacatgcagtgtttggttttttgtccttgtgatagtttgctgagaatgatggtttccagcttcatccatttccctacaaaggacatgaactcatcattttttatggctgcatagtattccatggtgtatatgtgccatattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttccagatccctgaggaatcgccacactgatttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgctttttggctgcatgaatgtcttcttttgagaagggtctgttcatatcctttgcccactttttgaagggtttgtttttttcttgaaaatttgtttgagttctttgtagattctggttattagccctatgtcagatgagtaggttccaaaaattttctcccattctgtaggttgcctgttcattctgatggtggtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccaccttgaattaatttttgtataaggtgcaaggaagggatccagtttcagctttctacatatggctagccagttttcccagcaccattgattaaatagggaatgctttccccatggcttgtttttgtcaggtttgtcaaagatcagatggttgtaggtgtgtggtattatttctgagggctctgttctgttccattggtctatatctctgttttggtaccagtaccgtgctgttttggttactgtagccttgtagaatagtttgaagtgaggtagcgtgatgcctccagctttgttctgttggcttaggattgacttggcgatgtgggctcttttttggttccatatgaactttaaagtagttttttccaattctgtgaagaaagtcattggtagcttgatggggatggcattgaatctataaataaccttgggcagtatggccattttcacgatattgattcttcctacccatgagcatggaatgttcttccatttgtttgtatcctcttttacttcattgagcagtggtttgtagttctccttgaagaggtccttcacatcccttgtaagttggattcctaggtattttattctctttgaagcaactttgaatgggagttcactcatgatttggctctctgtttgtctgttattggtgtataagaatgcttgtgatttttgcacattgattttgtatcctgagactttcctgaagtttcttatcagcttacggagattttgggctgagatgatggggttttctagatgtacaatcatgtcatctgcaaacagggacaatttgacttcctcttttcctaattgaatgcccaccttctcctgcctgattgccctgtccagaacttccaacactatgttgaataggagtggtgagagagggcatccctgtcttgtgccagttttcaaagggaatgcttccagtttttgcccattcggtatgatattggctgtgggtttgtcatagatagctctcattatttagagatatgtcccatcaatacctaatttattgagagtttttagcatgaatggttgttgaattttgtcaaaggccttttctgcatctgttgagaaaatcatgtggtttttgtcatttgttctgtttatatgctggattatgtttattgattttcatatgttgaaccagcgttgcatcccagggatgaagcccacttgatcatggtggataagctttttgatgttttgctgggtttggtttgccagtgttttactgaggatttttgcatcaatgttcatcaaggatattggtctaaaattctctttttttgtgtgtctctgacaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccgtttcttctagatattctagtttattttcatagaggtgtttatagtattctctgatggtagcttgtatttctgtgggattggtggtgatatcccctttgtcatttattattgcatctatttgattcttctctcttttcttcttcattagtcttgctagtggtctatcaactctgttgatcttttcaaaaaatcagctcctggattcattgattttttgaagggttttttgtgtctctatctccttcagttctgctctgatcttagttatttcttgccttctgctagcttttgaatgtgtttgctcttgcttctttagttcttttaattgtgatgttagggtgtcaattttagatcttacctgctttctcttgtgggcatttagtgctataagtttccctctacacactgctttgaatgtgtcccagagattctgatatgttgtgtctttgttctcgttggtttcaaagaacatctttatttccgccttcatttccttgtgaacccagtagtcattcaggagcaggttgttcagtttccatgcaattgagtggttttgagtgagtttcttaatcctgagttctagtttgattgcactgtggtctgagagacagtttgttataatttctgttcttttacatttgctgaggagtgttttacttccaagtatgtggtcaattttggaataggtgtggtgtggtactgaaaagaatgtatattctgttgatttggggtggagagttctgtagatgtctattaggtccgcttggtgcagagctgagttcaattcctggatatccttgttaactttctgtctcgttgatctgtctaatgttgacagtggggtgttaaagtctcccattattattgtgtgggtgtctaagtctttttgtaggttactaaggacttcctttatgaatctgtgtgctcctgtgttgggtgcatatatatttaggatagttagttcttcttgttggatggatccctttaccattatgtaatggccttctttgtctcttttgatctttgttggtttaaagtctgttttatcagagactaggattgcaacccctgcctttttttattttccatttgcttggtagatcttcctccatccctttattttgagcctatgtgtgtctctgcacgtgagatgggtttcctgaacacagcacactgatgggtcttgactctttatccaatttgccagtctgtgccttttaattggagcatttagcccatttacatttaagattagtattgttatgtgtgaatgtgatcctgccattatgatgttagctggctattttgctcgttagttgatgcattttcttcctagcctcgatggtctttacaacttggcatgtttttgcagtggctggtaccagttgttcctttccatgtttagtgcttccttcaggagctcttttagggcaggcctggtggtaacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtggagtttctgccgagagatcagctgttagtctgatgggcttccctttgtgggtaaccccacctttcactcaggctgcccttaacactttttccttcatttcaactttggtgaatctgacaattatgtgtcttggagttgctcttcttgaggagtatctttgtggcgttctctatttcctgaattcgaatgttggcctgccttgctagattggggaagttctcctggataatatcctgcagagtgttttccaacttggttccattctcccagtcactttcaggtacaccaattagatgtagatttggtcttttcacatagtcccatatttctcggaggctttgttcatttctttttattcttttttctctaaatttctcttcacgcttcatttcattcatttcatcttccatcgctgataccctttcttccagttgatcgcgtcagttactgaggcttgtgcattcgtcacgtggttcttgtgccttggttttcagctccatcaggtcctttaaagacttctctgcattggttattctagttatccattcgtctaattttttttcaaagtttttaacttctttgccattggttcaaacttcctcctttagcttggagtagtttgatcttctgaagccttcctctctcaactcgtcaaagtcattctccatccagctttgttccgttgctggtgaggagctgcgttcctttggaggagaggcgctctgagttttagagtttccagtttttctgctctgttttttccccatctttgtggttttatctatgtttggtctttgatgatggtgacgtacagatgggtttttggtgtggatgtcctttctctttgttagttttccttctaacagacaggaccctcagctgcaggtctgttggagtttactggaggtccactccagaccctgtttgcctgggtatcagcagcggtggctgcagaacagcggatattggtgaaccgcaaatgctgctgcctgattgttccttgggaagttttgtctcagaggagtacccggccgtgtgaggtgtcagtctgcccctattggggttgtctcccagttaggctactcgggggtcagggacccacttgaggaggcagtctgcccgttctcagatctcaagctgcgtgctgggagaaccactactctcttcaaagctgtcagacagggacatttaa

SEQ ID NO: 12504 - DNA, 44311 bp, Homo sapiens
cttccacaacgattgaactagtttacagtcccaccaacagtgtaaaagtgttcctatttctccacatcctctccagcatctgctgtttcctgactttttaatgattgccattctaactggtgtgagatggtatctcattgtggttttgatttgcatttctgatggccagtgatgatgagcattttttcatgtatttcttggctgcatgaatgtcttcttttgagaagtgtctgttcagatcctttgcccactttttgatggggttgtttgtttttttcttgtaaatttgtttgagttctttgtagattcaggatattagccctttgtcagatgagtagattgcaaaaattttctcccattctgtaggatgcctgttcactctgatggtagtttctttgctgtgcagaagctctttagtttaattagatcccatttgtcaattttggcttttgttgccattgcttttggtgttttagacatgaagtccttgcccatgcctatgtcctgaatggtattgcctaggttttcttctagggttttaatggttttaggtctaacatttaagtctttaagccatcttgaattaatttttgtataaggtgtaaggaagggatccagtttcagctttctacatttggctagccagttttcccagcaccatttattaaatgggaaccccttccccatttcttgtttttgtcaggtttgtcaaagatcagatggttgtagatgtgtggtattatttctcagggctctgttctgttccattggtctatatctctgttttggtaccagtaccatgctgttttggttactgtagccttgtagtatagtttgaagtcaggtagcgtgatgcctccagctttgttcttttggcttacgattgacttggcaatgtgggctctttttgggttccatatgaactttaaagtagtttttttttccaattctgtgaagaaagtcattggtagcttgatggggatggcattgaatctatcaattaccttgggcagtatggccattttcatgatattgattcttcctatccgtgagcatggaatgttctcccatttgtttgcgtcgtcttttattttgttgagcagtggtttgtagttctccttgaagaggtccttcacatcccctgtaagttggattcctaggtattttattctctttgaagcaatagtgaatgggagttcactcatgatttggctttctgtttgtctgttattggtgtataagagtgcttgtgatttttgcacattgattttgtatgctgagtctttgctgaagttgcttatcagcttaaggaaattttgggctgagacaatggggttttctaaatatacaatcatgtcatctgcaaacagggacaatttgacttcctcttttcctaattgaataccctttatttctttctcctgcctgattgccctggccagaatttccaacactatgttaaatttgagtggtgagagagggcatccctgtcttgtgccagttttcaaagggaatgcttccagtttttgcccattaagtatcatataggctgtgggtttgtcttaaatagctcttattattttgagatacatcccatcaatacctaatttattgagagtttttagcatgaagggctgttgaattttgtcaaaggccttttctgcatctattgagataaccatgtggtttttgtctttggttcagtttatatgctggattacgtttattgatttgcatatgttgaaccagccttgcatcccagggatgaagcccatttgattatggtggataagctttttgatgtgctgctggattcggcttgccagtattttatcgaggatttttgcattgatgttcatcggggtattggtctaaatttctcttttcttgttgtatctctctcaggctttggtatcaggataatgctgccctcataaaatgagttagggaggattccctctttttctattgattggaataatttcagaaggaatggtaccagctcctccttgtacctcttgtagaatttggctgtgaatccttctggtcctagactttttttggttggtaggctattaattattgcctcaatttcagagcctgttattggtctattcagggattcaacttcctcctggtttagtcttgggagggtgtatgtgtccaggaatttatccatttcttctagattttctagttttttctttttttgtgtgtgtataggtgtttatagtattctctcatgatagtttgtatttctatgggatcggtgatgatatcccctctatcattttttattgtgtctatttgattcttctctcttttcttctttattagtcttgctagcagtctatcagttttgttgatcttttcaaaaaaccagctcctggattcattgattttttgaagggttttttgtgtctctatctcgtttagttctgctctgatcttagttatttcttgccttctgctagcttttgaatgtgtttgctcttgcttctctagttcttttaatcgtgatgttagggtgtcaattttagatctttcctgctttctcttgtgggcatttaatgctataaatttccctctacacactgctttgaatgtatcccagagattctggtatgttgtgtctttgttctcactggttttaaagaacatctttatttttgccttcatttcgttatgtacccagtagtcattcaggagcaggttgttcagtttccatgtggttgagcagttttgagtgagtttcttaatcctgagttgtagtttgattgcactgtggtctgagagacagtttgttataatttctgttctttcacatttgctgaagagtgctttacttccaactatgtggtcaattttggaataagtgcagtgtggtgctgagatgaatgtatattctgttgatttggggtggagagttccgtagacgtctattaggtctgcttggggcagagctgagttcaagtcctgaatatcctttttaactttgtgtcttgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttatcattatgtaatggccttctttgtctcttttgatctttgttggtttaaagtctgttttatcagagactaggattgcaacccctgcctttttttgttttccatttgcttggtagatcttcctccatccctttattttgagcttatgtatgtctctgcacatgagatgggtctcctgaatacagcacactgatggatcttgactctttttccaatttgccagtctgtgtcttttaattggggcatttagcccatttacacttaaggttaatattgttatgtgtgaatttgatcctgttattatgatgttagctggttattttgccccttagttggtgcagtttcttcctagcatcgatgttctttacaatttggcatgtttttgcagtggctggtacaagttgttcctttccatgtttagtgcttccttcaggagctcttttagggcaggcctggtggtgacaaaatctcttagcatttgcttgtctgtaaaggatttcatttctccttcacttatgaagcttagtttggctggatatgaaattctgggttgaaaattcttttccttaagaatgttgaatattggcccccactctcttctggcttgtagggtttctgccgagagatctgctgttagtctgacgggcttccctttgtgagtaacccgacctttctctctggctgcccttaacattttttccttcatttcaactttggtgaatctgacaattatgtgtcttggggttgctcttctcaaggagtatctttgtggcattctatgtatttcctgaatttgaatgttggcctgccttgctaggttggggaagttctcctggataatatcctgaagagtgttttccaacttggttccatgctccccgtcactttcaggtacaccgatcatacatagatttggtcatttcacatagtcccatatttcttggagtctttgtcagtttctttttacccttttttctctaaacttctcttctcgcttcatttcattcatttgatcttccatcactgataacctttcttccagttgatcgaattggctactgaagcttgtacattcaacacgtagttctcgtgccatggttttcagctccatcaggtcatttaatgacttctctacactggttattctagttacccattcgtcgattttttttcaaggtttttagcttctttgtgataggttcgaagttccttctttagcttggagaagtttgatcatctgaagctttcttctctcaactctttaaagtcattctctgtgcagctttgttccattgctggtgaggagctgcattcctttggagcgggagaggcactcaatttttagaattctcaggttttctgctctgttttttctccatctttgtggttttatctacctttggtctttgatgatggtgatgtacagatggggttttggtgtggatatcctttctgtttgttagttttccttccagtagtcaggaccctcagctgcaggtctgttggagtttgctggaggtccagtccagaccctgtttgcctgggtatcagcagtggaggctgcagaacagcgaatattgctgaacagcaaatgttgctgccttatcgttccttgggaagcttcatctcagagaggtaccggccgtgtgaggtgtcagtctgcccctactggggggtccctcccagttaggctactcaggggtcggggacccacttgaggaggcagtctgtccgttctcagatctcaaactccatgctgggagaaccaccactctcttcaaagctgtcagacagggacatttaagtctgcagagatttctgctgccttttgtttggctatgccctgcccccagaggtggagtctacagaggcagtcaggcctccttgagctgaggtggcctccacctggttcaaacttcccggccactttgtttacctactcaagactcagcaatggtgggtgcccctcccacatcctcgctgccaccttgcagttagatctcagactgctgtgctaacaatgagcgaggctctgtgggcgtgggaccctctgagccaggcacaggatataatctcctggtgtgccgtttgctaagaccattggaaaagcacagtattagggtgggaggacccaattttccaggtgccatctgtccagcttcccttggctaggaaagggaattccctgaccccttgtgcttcccaggggaggcgatgcctcgccctgctttggctcacgctcggtgggctgcacccgctgtcctgcacccactgtccaacaagccccagtgagatgaacctggtacctcagttggaaatgcagaaatcacccaccttctgcatctctcatgctgggagccgtagagtggagctgtttctattcggccatcttggaaccacccccagctgaatctttcttaagccacaattctgaacactgctttttatgccttcagctaaatttactatttgttaactcatatttagaaaacagaattaagtagtttgggagctagaagttcaggctcaaacaatttatcagtgctagatccagaactagcaccctaggccttgacacccctgtttatggatgtttttctgtttatgtttgttttatttgttcaaccaaaatttaaacaacttgagggcacagcccctctccttatgatttcccattgctcagaaggaagctttgcacctaaacgcacactggtaatgcagaaaggaaatctggtgctttaggttacaaattagattaaatggatttatgggctaaacattttcaattcttgcttgccatataatgagagaaattaaagcccattaaatgattaatactttatctaatgactatcctcccaggagttcaaagtctttttgaaataatgctctaacattcagtattcaactattccttgagcacttctgaaagcagcagtaatatagttagggtacctctgagtgtactgatatgagtacttccaaatgggttcttcctgcttactgtgactccacgagagaatcaggttcatttgattcctttgttcttacagtccccctgtgaaacctgcgtcatcacaatacagaggcctgcatcttactgcacaagtggagaggccatcttctaacatgtttaacactgcaggttccctcaacccatcagtgtcatctcagaaggatcccagtggaattttgttacttctgggactctttcttttttcattttacataatgtgttctcttctgtgccattgtccttgttacataaaactaagcatccctccatatatgaaggaaacaaaaccagtatctcaaagacatatctgcactcccatgttcagtgaagcattacccacaatagacaagacatggaaacaatgtaagtgtccaaggacagattaatggataaagaaaatgtgatccacacccacacccccacaacacacacacaatggaatataattcagccataaaaagaaggaaatcctgtcatttgtaactacgtggatgaaactcgtgggcattaagctaagtaaaataactcagagagagtaagacaaatactgtatgatttcatgtacatgtggaattcaaaaagttgaactcactgaaactgaaaataaaatgatgttttcccagggaaaggaggtggggaaaatgggagctgtttattgaagggtacaaaccttcagttatgtgatgaataagttctagggatctaatgtacagtatggtgactatggttaataatgttgtattgtctacttgaaatttactaagagagtagatcttaaatagttttgccacacacaaaaaaggtagctatgggaggtgatggatgtgttaaccaacttaattgtgacaatcattttaccatatatatgtatatcaaatcatcatgtacactttaaatttatataattttattgtcaattatacctcacaaaagggaaaaaatgtaaacttaaaatattttttgaattaaaaaattaagcatttctccttagtggcctgattggaatctcagaatgtttactttcccactgatcccaatcaggcaggtgaacttcactgactcagttgcttaggacccagcaacttcggggtcatggtttttgagactctcggtaaggaaataaatatatttacagtatctgcttgggacacttgtagatcacagtccactgccttatttttaacaatattatccatatatctgtttttataccactgacccatctatctttcttattctcatgaactgaattttaaatttttttctcacctatttttaataatttcccctgataaaactttgcggttaaaaaaaaattcctgcaatatcccccaaattagaatagcaatgaaaacaagaaagtaaaattactatcatcttattcttataatatctaagttgtggaataccctattttcttagaatcataaaattttagaatgggaaatgtccttagagaatttgacagttacaatacagtgcggagtaactagaatgctttatgaatggctcattctaattcagtaaggaaatttcatttcatttgtcaggaaaggtatcaaccccttggaaatggccaagagagattgccaactgtccatcagattaatattgcaaatgtctagcagactctccagggattagctgattctatggggtgtgtacctttgattgcttttgacaaggccattttataaaatctgtagtgatatggtattacccttgtagaaaaccggtaagaatacaagtatttcttgtgtatagcaaagcaaatggtttctgttcatggtgatttaatttctccagtggagaatatgagtatctgtaagccaatttctcatttgaatctgtctcagtatcttacggattttctcattaatcaaagaattaaatagaatctttgacaatgttcattttgtatctgtatggaaattatgattttgtcattttgaaaattatgctttaaaacaactttgttctgaaaattttgtttaaaatctattaactgaggctcatgcctgtaatcccaccactttgggagactgaggcaggtggatcacgaggtcaggagatcaagaccatcctggctaacacggtgaaaccgtctctactaaaaatacaaaaaattagccgggcatggtggcgggcacctgtagtcccagctagtcaggaggctgaggcaggagaatggcatggaacctgggaagccgaaattgcagtgagccatgatcacgccattgcactccagcctgggtgacagagcgagactccaaaaaaaaaaaaaaaaatctattaactgattttctgtctttagtaaacagtatactttaatatggtaaacattattatatcttaaggaatttgtaatatttcagagtttttatgataggcaccaatttatagctatgtaactatctcggagacgtggtagcaaaatgactaagcagatgggtttagaaccagagtgctcagtaaaaatcccagctctcccctttatcagctgtgagctatatagccagttatttaaaccctttctgtttcagtttcttcatctttaccataagtttgatgtgagaatcaaatgaataaatatatgtaaagcacttggaacaattgcacagtgttttactgtgttttgtattgtcattctcaaaagaatcacagatgagtttaacttctgaatgctcaatcttgccatggggagagagaaaacctctcaagaatggggaaattttttgcctgtccagacctgggtgaacaagtctgtctaacttgaggtttcattgagtagccagtcccttgaggttctcaccctgagctagattccaacttgtcctctgtgagagttctgcattgtcaccttggctagtctgaactaaaatttcaataattctcctttttgtatatttgcagttaggatgggtcaaaaggagactcttgcaaagtttttggaaggcaggcaggaggcagcagacgttttgtagttgacacatctgttgctagtccactgactcatcttgctggtgtggggcagcaactgggcctacagatgctttacctgcccctgaatctttcctcaatttttcttgaaggttgtatgtttagctctataacaaagttcccagcttctgcaggataccttcatcaccaagagcaggtttcagtccattcctacgaggttccagcctattagtgagcttttcttcctgtctgcactgagaacttcatgctccagcatcagatttgtagccctccaagacggcttaaccagcccccgtaattgtataaacaaatcctgctttaataaatcccttcatatatatacacatatctcctactgactctacttctcttgttaaacctgactgatgcagaatttggtaacaggagtgaggaagccaggaagagtgcattcaactgtttattcattcactcaatacaaatggaccatattacatatatacaggttaaatatcacttatcagaaatgcatgggacaagaagagtttcgaatctggcggtttttcagattttgaaatattttcacatgcataatgagatatcttggggatgggacccaaggttaaactccaaatttactaatgtcttatacataccttgtatacatagtctgaaggtaatttcatatggtagttttaccaactttgtgcatgaaacaaagtctgtattgtgtaactaggtgtggaattttccattttccacttggaatattatgtcgctgctcaaaaagtctctgagtttgaagcattttggatttcagatttttagattaggaatgctcaacctgtaattatataatctgcctttatcacctgaaaacatatcatgaacattttgttctatgtgaatacttaatctatttttaatgggtagatagtcctttgtaattatgaaccatagtttatttaataaagtacttaatatgagcattcagattgcttcgaatgacaagcccaccataaacatttctgtacgtaggtatttgcatacttttctgattatcctcttaggataaattccagaagagaaattgtttagtcaagtgatatgctcaattaagttttttatttgtttgatcagaataggtgttccgatttcctcccctaccagctgtgtatgaaatgactcgattcttcagaacttccttgatattttaaatcaaggcacccacaatgaattgcagtggtttgttctgtgaattaaactggacttactattgcttttagaggtctctaaatgctgtctattaagccaattggctgctttccccttcaggtgacatctccatagccagcttttaaactcttagggtcagtgactgaagccagagcctttccagttctagttccgctgcacacctccaagaacctccatcagggccatcctccaccatataagactatgcttaaagcaagcaaataggccaatgctagctgaggaagttttctgaaagcagcttgcttgtgggtagtgctgatgtgctttcattcaccactgtttgcaaagtactaaagtaattggagatctttagcaggaaattctgctgactgagagaggatgaagtgctgaaatccttttaactcccacagcacttactcagaaccatctgaatgcatttaaagtatctgttaaaagatgctaagaggagtttgaaagttatcaccagagcctacccagatggcaatgctcacataactgtttatttttcatcctgtttaaaagaatattctcacaatgcaggtttagaggtgatgaggaacctcagaatgacataatccattttaactataaaccataaatatccattaaaatctcatcccacccatactctctttttcttttcaaatgtgaaagaatacaatcctcctcttttcaaaaaaaataactgtgaaagctacttcactacaagtatagcagttgaaatggctttggcccataatccatggctttttctggttaatctttcttctctgctttttggttcaggagaataaactacatctcctttctgtagatattcacatacaagagaaggggtacaatagcactgttatggtgagtaaagtgttaaggaagtactggttaatccatgagggatgagccaacagtatcaatgcaataggtttgagaggttttatatcttccttggagatcaaaagaatactagaactggcggactaggagatgaaaaagtaattaaaagaatggatatgtgacaaagacatagtagcattcaaagaactctatttcagaaatgtgaaacagaaggaatttttgcaagtaaaatttatttaaaagacttgagaagtgtcccacttctgagtggcttcttgagtgtgaggttgctgtctaattagcaagataaatttcagggcatataactgcatgggtgtgtttgtatactggtagccatttaggtgaaagtgtcccttcttgttaacaagcaaagttcctctgtcatttggaatcatctgaaacatttttttggtttctctggaaattttatggtctctattatccaaatgattcagaaatgaaatgttgtttgcccctgagagctttcctactgagcagtgtgtctacagattgcagtctgacaacaatatcaactagttttaagagagaaaaaaattgagtcgctagaaataaagggagtccttcatcctcagacatactgggccaggcagtcagtattcagctctggattcaaagcccttgcttggtaacattgtcctggtgtcctggttgtttatggccaatgatcatttgaatcttcaggagtctgtaacattgtttaaaaaggcttgaggagaggagtggagcaagatggccaaatagaaagctccaccaatcgtccccctaccaagacactagtttttgtttttgtttttgttttttgttttttgtttttccagatggcgtctcactctactgcccaggctagagtgcaatggtgcaatctcagctcactgcaaccttcgcctcccaggttcaaatgattctcccgccttagcctcctgagtagctgggattataggtatccaccatcaagcctggctaattttagtatttttgtagagatggggtttcactgtgttggccagactggtcttgaactcctgaccttaggtgatctgcccgccttggtctcccaaagtcctgggattacaggcatgaaccaccgtgtctggcccaaggacaccaatttaacaactatctattaatacatttaaaaagcacatttatatgaaccaaaaataggataaacactcacagttgttgattttaacttcgtatcactgaaagaggcactgaagaagccaggaaagacagtcattaatcagtaacaccactcctccccttttcctcagtagtggctacatggcacagagaaagagtctgtgtgcttgagagagggaggacacagcaattgtgagacattgcattgaactcagtgctgctctgtcatggcagaaacaaaactgggctgaactctgctgatgcctgtccacgaagggagtatgtaaacccgacctagccagaggggtatcacacatcccagtagtcagaacttgagttccagtgagcctcaccaccatggcctaaagtgctctgaggccctaaataaacctgaaaggcagtctaggccacaaacactgcaattcctaggtgaggcctagggctgaactgagcttagagccagtggacttagggggcacatgatgtactaagacatccttggggtgcctatgggagtgcttgcaccaccgttcccccatcctcaggctgcacagcttatggctccaaaagagaccccgtccttctgcttgaggagaggagagggaaaagtaaagagaactttgtcttgaatattggatacctgctcagccacagtacaatagggcatcagtcagagttgtgaggtcccctttccaggtcctagctcctggacaacatttctagacacactctgggccagaagggaaaagactaaacagcccttggaccctgaataaccagcagcaacacccaggtagtatgctgtaggccttgggtgagactctgaggcatggtggttttaggtgtgacccaccacattcccagttgtggtggctatgagaagagactctttctacttgaaaaaggggaagggaaaagtgaaggggactttgtcttgttccttaggtactagctcagccacatgagagtagagcaccaagtgggctcttgggggctatggttccaggccttggttcttagacagcatttctggacctgccctgagttagaggtaagcccactgccttgaagggtgtcataggcctggaagcattcatcacaagctaactaaagagatcttgggccttacacgtacactgatggtagcctggctgtactccccatgggcctgtggtgatggtgaccaaggggagaggctcctctgcctgtggaaaggggagggaagagtgggaaggactgcgtctcatgatttgagtgtcagctcagtctcagtaaaagaaaacaccaggtaggcatctaagggtttttaactccagtccctggctcctggacagcacttctggagcctcctgggccctagggaaacttaatgtcatgaaggggagaacacaaccctggctggcttcatcacctgctgattgtagagccctggggccttgagtgaacattggcagtgtccaagtgatagttacagtgggcactgggaagacccagtgctgtgctggctttaggtctgacccagcacattcccagtggtagtggtcaaaagagtgcttggattacaacatccatagttctaggcagctcaccacagagacagagactccattcatctgggagaaagtaagggaagagaacaaagtctctgcctggtaatccaaagattcttctggatcttttccaaaataatcaatgtggtacctctaaaagactccaaaaagtacaacattgttgggcttggggtggcccctaatgcagatacagcttttattaaaacacccaagtccttttgaatacttggaaagccttcccaaaaaaggaagaatacgaagaaggccagactgagaagactgcaataaatacctaactcttcaatgcctggacacagacaaacatccacaaacatcaagaccatccagaaaaacatgacctcaccaaatgaactaaataagtcactagagaccaatcttggagaaacaatgatatgtgaccattcagacagggaattcagaatacctgttttgagaaaactcagtgaaatccaagataacatagagaaggaattcagaatattgttcagataaattcaacaaagagattgaaataatttaaaataatcaagcaggaattctggagttaaaaatgcaaacgacatactgaagaatgcatcagagtcttttaatagcagaattgatcaagcagaagaaagaattaatgagcttgaaggcaggctatttgaaaaaacatagaggagacaaaagaaaaaagaatagaaaacaatgaagcatacctacaggatctagaaaatagctttaaatgggcaaatataagagttattggccttacagagcaggtagagaaagagataggggtagaaggcttattcaaagggataataagagcttcccaaacctagagaaagatatcaatattcaagtacaagaaggttatagaacaccaaacagatttaacccaaagaatactgcctcaagacatttaaaaaacaaactcccaaagatcaaggataaagaaaggatcataaaggcatcaagataaaaagaaacaaataatatacaatggaactccaataagtctggtagcagatttttcagtggaaaccttataggccaggatagaatggcttgacatatttacagtgctgaaggaaaatatcttcagatatgaagcagaaataaagactttcccagaaaaactaaaactgagggattttgatcaatactagacctttcctacaaggaatgctaaagggagttcttcaatcagaaagaaaaaactgttaatcggcagtaataaatcacctgaagatagaaaactctctggtaacggtaagtacacagaaaatcaaagaatattataatactgtagttgtggtttgttaactactcttcagtagaaagactgaaagtagaaagatgcaccaatcaaaaacaataaatgcaatgactttttaagacttagacaataaaataagatataaatagaaacaacaaaaaggtaaaaagcagggggatgaagttatggcatagagtttgtattagttttctttttgcttgttgtttgtttatgcaaacagtgttaacttgttatcaacttaaaataatgggttatatgattgtatttgcaagcctcatggtaacctcaaatcacaacagatacacaaaagataaaacgcaagaaattaaatcacaccaccagagaaaaaacacctccactaaaaggaagacaggaagggaggaaagaagaaaagagcagatcacaaaacaaccagaaaacaaataacaagatggcaaaactaattggactaaagtctccaatttgattggagagtttgattggactaaactctccaatcaaaagatatagagtggctgaatagattaaaaaacaatgatcaattgcctataagaaacacactttacctataaagacaaacacagactgaaaataaagggatggaaaaagatattctatgccagcggaaaccaaaaaagagcagaagtagctatacttatatcagacaaaatagctttcaagacaaaagctgtaagacaagacaaagaaggtcactatttaattataaagtggtccattcaggaagagggtataataattgtaaatacatatgtaccccacactggatcactcagatacatatatatatagcaaatatttttagagctaaagaaagagggagagagaccccattaaaataatagctgaagacttcaacaccccacttttagcattgaacagatcttccagacagaaaatcaacaaagaagtatgggacataatctgcactatagattaatggacctaataaatatttacagaatagttcatccaaaggcagcagaatacacattctttcccttagcacatggatcattctcaaggatagacccacaaaacaagtcacaaaacaagtattaaaacgttcaaaaaatgaaataatatcaaatgtcttctctgactacagtgtaataaaacttgaaatcaataataagaggaattttggaaactgtgcaaacacacaaacattagacaatatgctcctaaatgagctgtaggtcaatgaagaagttaagaaggaaatagaaaaaaaattttgaaacaattgaaaattgaaatacaacatactaaatcctgtgggatacagtgaaagcagtaataagaggtaaatttataggtataagtgcctacatcaaaaaagaaaaaatacttcaactaagcaacctaacaatgtattttaaacaactaggaaagcaagagtaaaacaaatgcaaaattattagaagaaaagaaaaaataaaaatcataggagaaataaatttcaaataaagtaaaccacttaaaaaatcaacaaaacaaaaagttggtgtttttttttttttgttttgttttttttctgagaccgagtctcactctgtcctccaggctggagtgcagtggcgggatctctgctcactgcaagctccgccccctaggttcatgccattctcctgcctcagcctccccagtagctgggactacaggtgcccgccaccatgcctggctaattttttgtatttttagtagagacagggtttcaccgtgttagccaggatggtctcaatctcctgacctcgtgatccacctgccttgtctcccaaagtgctgggattacaggtgtgagccaccacgcctggtcaaaagttggtcttttaaaaagataaacaaaattgacaaaactatagcaagactaatggagaaaaaaaaggagaagacccaaatatataaaatcagagatgaaaaaggagacattacaaccaaaaccacagacattcaaaggattattagcagctgctatgagcaactatatgccaataaattggaaaatcaagaagaaatggataaatccccagacacatgtaacctaccaggattgaaccacaaagaaatccaaaacctaaacagaccaataacaagcaaggagattgaagctgtaataaaacatctcccagcaaagaaaagcccaggacctgatggcttcatgctgaattctaccaaacacttaaaaaggagctagtaccaattctattcaaactattgcaaaaaatagaggaggagagactacttcaaaactcattctacgaggccagtattaccctgataccaaaaccagacaaaatctatacatcaattaaaaaaatacataggccaaccactgattaatgttgatacaaaaatcctcaacaaaatactagcaaactgaatttaacaacacattaaaaagatcattcatcatgaccaagtgagatttatcccagggaagcaagaatggttcaacatattaaaatcaattgatgggatacatcaaataaacagaatggaggacaaaaaccatatgatcatttcaattgaggctgaaatagcttttgataaacttcatcatcccttcatgataaaagcccttaaccaattgcgtatagaaggaacatacctcaatataataaaaggcatatacaacagacacatagtatcatactgaatgggaaaaaactgaaagtcttttctctaagatcaagaacacaacaagattgcccatcttcaccactgttattcaacatagtgcaatcaagcaagagaaagaaataaagggcatccaaattggaaaggacaaagtcaaattagcctttttggcagataatataatcttacatttggacaaacctaaataccagaaaacttttagaacggataacaattcattacagttgcaggatatcaaatcaccatacaaaaatcagtaccatttttatatgccaacagtgaaccatccgaggaagaaatcaagaaagtaatcccatttataatagctacaaataaaatgagaaatacctagtaattaaggtaaccaaaaaaaatgaaagacctctacaatgaaaactataaaacattgatgcaagaaattgaggaagacacaaaaaatggaaagatgttccatgttcatggattggaagaattaatattgttaaaatgttatactacccaaagcaatctacagattcaatacaatccctatcaaaatactaatgccattcttcacagaaacataaaaaacaattctaaaatctatatgggaccacaaaaggcccagaatagccaaagttatccaaagcaaaaggaacaaaactgaaggagtcgcattacctgacttaaatttacactacagtgctacagtaaccaaaatggcatgacactagcataaaaacagacacatagatcagtggactagagaacacagagataaatctatacatttaccgtgaactcatttttgacaaaggtgttaagaacacacttggagaaaggacagtctcttcaataaatgatgcagggaaaagtggatatcactatgcagaagaatgaaactagacctctacctctcaccgtttgtaagaaaccaaatcaagatgaattaaagacatgaatctatgaaactactaaaataaaacattaggggaaactctccagtacattgatctgggcaaagatttcttgagtaatatcccacaagcagagtcaaccaaagcaaaaatggaaaaatgggatcacatcaagtcaaaaaccttctgcacagcaaaagaaacaatcaacaaagtgaagagacaacatacagaatagaaggaagtatttgcagactacccatctggcaagggattagtaaacagaatatatgaggagcttatacaatgctacaggaaaaaatctaataatccaatcaaaactaggcaaaagatctgaatacacatttcccaaaagaagacatatgaatggcaaacaggtatataaaaaggtgctcaacatcactgatcatcagagaaatgcaaatcaaaactacaatgagatatgttctttttttttattatactttaagttttagtgtacatgtgcacattgtgcaggttagttacacatgtatacatgtgccatgctggtgtgctgcacccactaactcgtcatctagcattaggtatatctcccaatgctatccctcccccctccccccaccccacaacagtccccagagtgtgatattccccttcctgtgtccatgtgatctcattgttcaatccccacctatgagtgagaatatgcggtgtttggttttttgttcttgcgatagtttactgagaattatgatttccgatttcatccatgtccctaaaaaggacatgaattcatcattttttatggctgcatagtattccatggtgtatatgtgccacattttcttaatccagtctatcattgttggacatttgggttggttccaagtctttgctattgtgaataatgctgcaataaacatacgtgggcgtgtgtctttatagcagcatgatttatagtcctttgggtatatacccagtaatgggatggctgggtcaaatggtatttccagttctagatctctgaggaatcgccacactgacttccacaatggttgaactagattacagtcccaccaacagtgtaaaagtgttcctatttctccacatcctctccagcacctgttgtttcctgactttttaatgatcgccattctaactgatgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaatgttctcccattttgtaggttgcctgttcactctgatggtagtttcttttgctgtgcagaagctccttagtttaattagatcccatttgtcaattttggcttttgttgccattgcttttggtgttttagacctgaagtccttgcccatgcctatgtcctgaatggtaatgcctaggttttcttctagggtttttatggttttaggtctaatgtttaagtctttaatccaacttgaattgatttttgtataaggtgtaaggaagggatccagtttcagctttctacatatgactagccagttttcccagcaccatttattaaatagggaatcctttccccattgcttgtttttctcagggttgtcaaagatcagatagttgtagatatgtggcgttatttctgagggctctgttctgttccattgatctatatctctgttttggtaccagtaccatgctgttttgcttactgtagccttgtagtatagtttgaagtcaggtaatgtgatgcctccagctttgttcttttggcttaggattgacttggcgatgcgggctcttttttggttccatatgaactttaaagtagttttttccaattctgtgaagaagggcattggtagattgatggggatggcattgaatctgtaaattagcttgggcagtatggccagttaaaatggcttttacccaagagtctggcaataacaaatgctggcaaggatgtggagtaaagagaaccctcatacactgttggtgggaatgtaaatttgtacaatcactatgaagaacaatttggaggttcctcagaaaactaaaaatagagccaccatatgatccagcaatcccactcctaggtatatacccaaaagaaacgaaattagtatatcaaagagatatctgtactctgatgtttattgaagcattattcacaatggccaagatttggaagcagcctaagtgtccatcaacacaggaatagataaagaaaatatggtacttatacatgatggagtactattcagccataaaaaagaatgagattcttgtcatttgcaacaacgcagatggaactggaggtcattatgttaagtaaaataagtcagacacagaaagacaaacttcacatattcttatttatttgtgggagctaaaaattaaaataattgaacaaatggagatagagggtagaaagatggttaccagaggctgggaagggtggtggggggtagggaggaagtgaagattgctaatgggtaccaaaaaaatagaaagaatgaataagacctagtatttgctagcacaacagggtgactgatatgactcggatctgtgtacccacccaaatcttacgatgaaatgtaatccccaatgctggaagtggggcatgatgggaggtgattacatcatgggggtggttttctcatggtttaacaccattcttcgttagtgctgttgttgtgatagtgagctctcatgagatccaattgtttaaaagtgagtggcacctcccccatctctcttgttcctacttcagccatgtaatgtgtatgttccttcttcactttctgttatgattgtaagtttcctgaagcctccctagaagctgagcaaaggccagaatcatgcttctatacagcctgcagaaccgtgaaggaattaaagctgttttctttatatgttacctagtctcaggtatttctctatagtcatccaagaatggactaatacagaaaattgctaccaggggtgaggcattgctataaagatacctgaaaatatggatcccagtttggaactgtgtaaagggtagaggttgaaagaatgtggtgggctcagaagatagaaagatgagggaaaatttggaacttcctacagacttggtaaattgtgacaaaaatgctgatgctgagatggacaatgaagtctaggctgaggaggtctcagaagaaaatggggaacttattgggaactggaataaaggtcacttttgttatctattagcaaagaacttgggggcattatgcctctgccctagggatctgtggaaattttgacttgagagtcatgacttaggatatctggcagaaaaaatgacttaggatatctggtagaagaaacaacctatgctcatatatgtgagcaaagaaatgacataaaactggaacttatatttagaaggtaaacaaagcataaaagtttggaaaacttgcagcctgaccatgtggtgaggaattcaatcaggctgcagaaatttgcataagtaaagaagaaccgatagccaagacaatgggaaaaaggccttgaaggcacttcagagacctacacagcagcccctcccatcacaggcctggagggctaagagggaagaatgatttcatgggccacgcccaaggccctgccaccctgcacagcctcaggacattgctctcagcatccctgtcacttcagctccagccttggctcaaagaggcccaggtacagcttgggccactgcttcagagggtgcaagccataagccttggcagcttccacgtggtgttaagcctgtaggtgcacagagtgcattagctgaggctcggtagcctcctcctagactttagagaatgtatggaaaagcctggatgttcaggcagaggcctactgcaggggtggaaccatcatggagaacttctactagggcagtgcagagggtaaatgtgggtttggaggccccacacagagtccccactgggacagtgcttagtggagctatgagaaggccaccatcctctggaaccaggaatgctaccaacagcttgcactatgaacctggaaaagccacaggcactcaataccaccccttgagagcaactgtgggggctgtaccctggaaagccacagaggcagagtttcccaagactttgagagcccacctcttgcaccagtgtaccctggatgtgagacactgagttaaaggagattattttgcagttttaagagttaataactgccctgctgggttttggacttgcatgggccctgtagcccctttcttttggccaatttctcccttacccagtgccataaccccattgtattttgggagcaactaacttgtttttcatgttacaggctcgtaggtggaaggaaattgccttatctcagatgagactttggactttggacttttggcttaatgctagaataaactaagactttgggagactgttgggaagccatgattgtattttacaatataagaaggacatgagattttgaggggccaggggcagaatggggtttggtgtcctcactaaatctcaagttgaattctaatacccagtgttggagtggggcctggtgggagttgattgcatcatgggggtggagttctcatgaatgggttagcaaaacccccacggtgctgttctcatgacagtgagtgacttatcatgagatctagttatttaagagtgtgcttcctgtgaacaattaaattgttctacagaatatgcaggtagcttccgctttgccttctgccatgagtaaaagcttcctgaggccccctcagaagcagactctgacatgtttcctgtttatcctataaggcaattaaacctctttctttttttttttttttttcagatggagtcttgctctgttgcccaagttggagtacagtgacgtgatctcagttcactgcaattaccacctcctggtttcaaggaattatcctgcctcagcttcctgactagctgggattacaggtgtgcaccaccatgcctggctagtttttgtgtttttagtagagaaggggtttcaccatgttggccaggctggtctcaaactcctgacctcaggcgatccacccactttggtctcccaaagtgctgggagtgagccaccatgccagtcgtctcttttctttataaattatccagtctccggtatttctttatagcagtgtgagaatggactagtacagtgactatagtaaaaaataatttaatattacattttaaaataattaaaagaatataattggattgggccaggcatggtggcttacacctgtaatcccagcactttgggaggccgagatgggcagagcacctgaagtcaggagttcaggaccaacctggccaacgtggtgaaaccctgtctctactaaaagtacaaaaagtaactgggcattgtggcatgcacctgtaatcccagctacttgggaggctgaggcaggagaatcactggaacatgggacatgaaggttgcagtgagccaagattgcaccactgcagtccagcccaggcaacagagtgagattgtctaaaataaacaaataaataaataaacaaaagaatataattggattgtttgttacataaattataaatgcttgtggtgattgataccccatttaccctgatgtgaatattatgcattgcatgcctataacaaaatctctcatgtaaccataaatatatgcctactacatctccacaaaaattaaaaattagaaaaaagatttgtagagagaagaacatgagttcagaggaagagggctttcaattttaggggctgagggttggggtggtttagctaacaatccatcattggaaagcaagttaggatgcctagcatgcattgcttgatgtagacctctaactctgttagagaaattttgaaggggtattagacttcaattccttcatcttacagataaagaaaaggaagactttgacattttctttacctgtaaattttcttatgtctatttactcggtaagtgttcagtgcacatgcagggtatgaggataaggatagagggatcagatgaatgatggaacaaaagaaatactgtaataatttgttgtcaaacctggctggaggaaatactgaaattaatgaagtatcttttctaatggagtactgcactgttccaagaattcacaaaactgagcatgattgatagtcttctaggttgattgggaggcattgtattcttgtataatccttcagtatctttgagaacattagtcacccctatacttttggaactccagaggatcatttgtacaggtttatgctagatagaatgtgagagaacaagtacactataaactacatcaccacctttcaggagcttaccaactaagtcaaatgacctcaacagacccatttattcagggtgtgtaatctctgtcttccagatctgatgccaacagtgtggactcatcgtttaagtagaaggatgtatgtattctaataaggcacttttttaaaaaattatattttaagttctgggatacatgtgcagaatgtgcaggtttgttacataggtatacacgtgacatggtggtttgctgcacccatcgacccatcatctacattaggtatttctcctaatgctatccctccccttgccccccaccccccaacaggccccagtgtgtgatgttctctttcctgtgttcacgtgttctcattgttcaactcccacttatgagtgagaacatgcagtgtttggttttctgttcctgtgttagtttgctgagaatgacgatttccagctttattcatgtccctgcaaaggacatgaactcatccttttttatggctgcatagtattccatggtgtatatgtgccacattttctttatccagtctatcaatgatgggcatttgggttggttccaagtttttgctattgtgaatagtgctaaaataagcatacgtgtgcatgtgtcattatagtagaatgatttataattctttgggtatatacccagtaatgggattgctgagtcaaatgatatttctggttctagatccttgagaaattcccatgctgtcttctacaacggtttaacaaatttacactcccaccaacagtgtaaaagcattcctatttctctatatcctctccagcatctgttgtttcctgactttttaatgatcaccattctaactggcatgagatggtatctcattgtgattttgatttgcatttctctaatgaccagtgatgatgagctttttttcatgtttgttggccgcataaatgtcttcttttgagaagtgtctgctcatatactttgcccactttctgatggggttgtttatttttttcttgtaaatttgtttaagttccttgtacattctggatattagctgtttgtcagattgatagattgcaaaaattttctcccattctgtaagttgcctgttcactctgatggtagtttcttttgctgtgcagaagttcttcagtttaattagatctcatttgtcaattttggcttttgttgccattgcttttggcgttttagtcatgaattctttgcccatgcctatgtcctgaatagtattgcctaggttttcttctagggtttttatggttttaggtcttatgtttaagtctttaatccatcttgagttaatttttgtataatgcgtaaggaaggggtccagtttcaattttctgcatatggctagccagttttcccaacaccatttattaaatagggaatcccttccccattgcttgtttttgtcaggtttggcaaagatcagatggttgtagatgtgtggcgttatttctgaggcctctgttctattccattggtctatatatctgttttggtaccagtaccatgctgttttgattactgtagccttgtagtatagttactaaggcacttttaattgctgacttggtgccatatattagatgatactgaatggacaagtgagcatggcctgggactttggaatagaatgccctctttgcagaaataagtagctcattcataggaaacaaaactatattcctgacctctcctgtaagctattatggtttttagcatgcaatcctgatgtatgtgtatttacctatttataaattgtattatgttgtacaaatataatatttgtacaaaatcaatatttaaaaggataagataaaaataaatcaaatagatatctatttgttccttcccgcagaaaatggggtgggtaaaactcatatgtaaattatttctagccatctctgaactatgttcattatacctcactttcaatcccagccccacctgaatattctgtttcctaatactaaattatacattaaaccttacaaaaaacatgttaagtaacaagggaaaaaagatggaaaataataaaataggtagcatatacaaacacacccatacacacacacacacatgaaaaacagcagcagcaaacaaagaagaagctatgtgcagctgctacggtattcatttctgtaacccctcacaatattgtggttggtattcataacttccttcttctattacacatcctatgttttctttcccattagccagaattttagctggctagggttcttacccaaaaagtctaaatcttcaattcctcttttttttaattggttgctgtagctttcagttaatatttagtattagaaaaggaggtagtaagagtcatcacagagaatctcttgggttccagaaacagtcctccctgttcacattttctagcatcaattctgtttcctcttggttgtcaagatcagccatcagccacccaaccagaataactctctccttctttgcctgttagcttcctattaatgaggaactaaaaatgatcaggtattcttggctctgaaaaatgaaaactttatttttctgaagtttcaaacttcagatccatagaaccattgttgtaaggatttctctcttgggaaccaagacctcagagtagcaggtcttgtagatgtagattcaaaaattctgcaaatgggttatttggtgtagtaatgagagaagtcattcccacttcaactcacttcttcctagactcatgtattctggctttgggagaaacagcaccctgtattgttcctcagttgaaagaaatatactatatcctatatgatggcaacatatgttctcagggttttatgttttttggtgctattgcatatggaagttgtaaattttcatttccgtgttattttcgtgttacataaaaatacaactgattttagtatactagccttgatcctgtgattttgttcatttcatttattagttctagtagtttttttaataaatcccttaggaattttatgtaaacaatcatgttatctacaaagagagagctttacttcttccttcctgatcattttttaaatttcttttttcctttttgccttatggcaatggccaaaacctccaggacaatgttgaaaagaagtagtgagagtgggtatcctctaaggagggtgcaccgcacactgcttagctggttctggtgtcctgaattcagcaaagagggctgagacccagacctctaaggagggtggagtgctgctggctggctggtgcaggtatgtcctgaatctggatctgcaagtgttacaaaaattacaaattggattcaactgctgctacaaggaagaactgtttctgctaagatgaagcattgctagagggataggcacaggaacaggaaaagaggaaaatgaaatcctttcctcatccttaactgtccagtttccctctggtgcttgcatttaaaaaaacagagcctaatacagaattagttggcagaacagagatgtagtttgccgcattccagatgcagcgtaacaacagtgagatacagtagagtggatttggagctgagggacaacaacttaataacaggcatgcaagaagtatgcattatggacttatcagacccaggaatacgttttcttggcttccagagtgagtcctagaagtcattagaactttacctctgtttttgttttatgctttagttctgagatttgtttgggaaagactcatgctctaacagttttgctctgctctgagatctgtctcctactgagatgacgggagcttacctctgtgaatttaagcttttgacctgaaacctctttcatgtttcactcctagtctaaactcagcctatcccagcttttctccctcattctttccccactttcctgactcatttgaacttacctccacaaaggattttattcttggccctgaaaaatgaaaactttatttttagcatcttgtgtgttaaatggtatgcttccattcaatgtactactagaacaggacttttatctctcccttcctttgacatattcatgcatacacatttacacactttataagcatatgcacacctggaaatgtcagtgtataaagactgacatttttgcttagaggagtgaagggaatttctcaccattgcacaaggagagaaatgccattaatattcagccttcacattggttgattctaaagatctttctcttcccattttccaccctattactcctctcttctttttaatactaagaataataactcaacttacaacacttcatttttcaaaatgttttcacatatcttgcagtatgtgacaatcacaacttctctggaaagaggacagatcacattattttctttatgtcacaagagaggaaacttggcttaggacattttccaatggaaggagaaaaatattgccaataggaagcattcaatcagtgaatctgtctccatttcagtgcaattttaattaaagctcattttcaaaacattttaaaattaatcttacatctataatacctgcaatctattttacttccagtgcctgtgtactattgagtagcactgtctgtgcttttatagattgttttatttgtcagggggcatgtgtaaggatgcaaatgtctttactgttcacttctaagtctgaaacttatcagatccaggcaaggtcattattgggagtaaagtcagaataaaatttgtgttgaatttacttgtaggaaactttaatgtcttaaaagcttattccccacagtattaatcagtacatttacatttttattctagttctctcttttctctacttttgttttttttttttttgcgtggccaatatccataagtttattttttttaagagtttatatgtataatgtaagggatttatttattatatgaaagattccataagaatttccaattaagctacaagaatagccacctatagcaccaaatgagggccacctgtattttaaaatgatggtaaccaagatcatgaagaatagcaatcaacacctaaggacagtagaaaacactatggttgtgtggcctgaatataagagagggagcacataggtacatttgtaatatgtctaatatgccaagaagaatgggagcagtcttagaggtggacctaggttggtaaacaatagctttttgcatttataactttttttcttttttttttcttttattattattatactttaagttttagggtacatgtgcacaatgtgcaggttagttacatgtgtatacgtctgccatgctggtgtgctgcacccattaactcgtcatttagcattaggtatatctcccaatgccatccctccaccctccccccaccccacaacagtccccagagtgtgatgttccccttcctgtgtccatgtgttctcattgttcaattcccacctatgagtgagaatatgcagtgtttggttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatacacccagtaatgggatggctgggtcaaatggtatttctagttctagatccctgaggaatcgccacactgacttccacaatggttgaactagtttacagtcccaccaacagtgtaaaagtgttcctatttctccccatcctctccagcacctgttgtttcctgactttttaaagattgccattctaactggtgtgagatggtatctcattgtggttttgatttgcatttctctgatggccagtgatggtgagcattttttcatgtgttttttggctacattaatgtgttcttttgagaaatgtctgttcatgtcctttgcccactttttgatggggttgtttgtttttttcttgtaaatttgtttgagttcattgtagattctggatattagccctttgtcagatgagtaggttgcgagaattttctcccattttgtaggttgcctgttcactctgatggtagttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatcattatttggagggtgctgtggtctgaatgatcatgtctctccaaaattcatgtgataaaacctggcccccaaggtggtggtattaaaaagtggggccttcaggaggtaattagatgatgagggcaaagccttcatgaaagagaaggtgctcatttgaaagaggctcaagggaactccctgggtgcttccttcatgggaggacatagctaaaggcaccatcgtgcaaatggagagtaagtccacaacaaacaatgaatctgctggcactttaatcttagatttcccagctcccagaaccatgagcagtaaatttctattatttataagttacccagtctaatgaatttgttatagcagcctgaatagaatagaatagaataagacaagcaggggggcatatcatttagaatatctggttcttcacttagtgaatggtttagaagaaaaaatacaaaatgaagggtatgccctaatttcttgctgcagtgttgactttgcattactccagagctaagagagtatagctagcgatcacttatatgaatccccctaagtatcttgtcttctgtttctcagcagtgatgtgggggtttctaactccatatccttccagtgtcttcttttttctttatgaagtggagtagccaatttccgggattacttacaactctagtcttgaggagtgaattggcaatcacaccaccatttcttagctataagcccggcaatccaaatcacaaactttcagcaaagaaattctctaaaatccaacaatttcatcctcatcccctgtgcctctgggatacagaaactcatgagatgattttattgaatgcttactactgtcagcctctcctgccttacaaacctgacttcactgtgatggttaacttatgtcaacctggctacttggctgggctatggttaagcagtttctggatgtttctgtgaaggttaaatgttaattgcatttaaatcagtggacttcgagtaaatcagtttaccctccacgatgtgggtggacctcatccaatcaattggaggcctgaagagaataaagactgatcttccccaagaaagaagaaattctgccagcagactgccttcagactccaactgcaaaaattctgagtctccagtctgccagtctaccctgaagatttaggatttgccagcctccacaatcatgtgagccaattccttaaaatctgcacccccatatatattctctctctctctctctctctgtcacacacacacacacacacacacacacgcacacacacatcctgttgctcctgtttctctggagaaccctgattgacttaacccttacaataattgttaagtagcattatcacattttcagagggtaaaactggagctcagagagattaaatgatattcccaagatcatacagttaatatgtagaaggaccagatttgaagctctgttgtttccaaagttagcgttctgactactatgctatatatttgttctgccatgctatgctatgccacactatattacaatgcaaagtcaaataaccatcactaaaacttaaacgtgcatgcaaagatccagtggcatcttaccttcctgaatagttttgagttatatgccataacccacatgctgtgtagcatgaattgatgaaacgaacatctgagatccttttgcctggggaacgtttaacagtgttgctcagaaaatgctacttcactcagctattgggagatccattttaacttggactcaagcagaaagaaattgtttcccccaaagattttgaatacttattttcttaatagctttgaaaaaaaacacttataacctgactatataagaatatactacagattaaattacttcaattgtattaaacaagggtataataaagaataatgtatcttcaattttaccactccaacaaaccaaacatttcattttttttagttttcttttcagttttgtacaagttataatgataatagacatacaatttttattctcctttcacaaaagaaaaaattattttaatagagggaagaaaagtacttttttttaatttcagaaggaaatttcacagccaagaagaaaatatcggtgttgagctatgcctgaaacgtgtcactttgtgtaccaagcacttagggctaaacataaaaaaaaaattaagctgatcccagatcattttctttgattcagttcacataattagaacctgatttgtaccaagagtgagtaaagaaaagtcaggaaagcccaggagaccctgttctccaagccgttgagaacatcatctattctaaacttaaattttagccacctgtgtaagcttcccagccattcagtaacctgctgatttgtgtaaagtaccccaagagtaaccaagaagatggactgtaagtgaaagcttctgtcaaacagaaagggcaaatcaatagaaaagtgtggtgctggaaaagcataaaaagcatagtggattatagcagaggggtgtaatccttcttttgttcttctgtagaaaaaaacgaaagaatgaatgagcctacactctggttagtggagcctggaatttcatggctaggtatattacactatatcatgtggccatctgctctggtcctattaaaattaggagttccttgggaaaacattaagttttacaacatcctaagaagtgtttcctgcaaaatgggttaaaattggtttgagataatgaagtcacagtatgagactgatgaatgcctcctccaggagctgttggggcagccagcaatgagccatgggaattggtattagatctggtcagaattggacatcttcactaatgatctggaagaggaagtcaatggctcattaatgaaatccacagataaagtggaatgatggattgattggatgcaagaaagcaaagaaattagtgatattagtaaaatgagatgcaacttatggaaatgttcactcatcctcgaaacagaaaatcaccatctggaagtcatttaaatggagcaatgagtccggaaagcaccactgccagcagaggcctggagatgatgccaggaaggttagacaaagatgggagatggagccagaacaatcagagcttctccctggaaagacctcatgacatttggccagtggagataagcttcccaaagctcctgacacccagccagagcctctgaaaaaccactctgcctctgtgtggtggccagcctgtcctctgacttctagctctggctggaaagatggctccagatgggcttctcattactgttttcaacaaggcaaggttgatggtgtccaacattttgctcctttgaggccaataattaggccaaggccagaggtacaggtccagcatcagtatgaaagactgaatagtgtgtcgattggggtcctctctggcccatacttccattctaagataggtgtgtgccatagtcacagtcctgctgcctgtggcatctgctgcttctgtcaccacacggcttgaccactgacctgctaaagctttcaaggctgtagcattttgagttccttttgctggcatccatgtgccaccccttccatgtcctatgacctcctgacgcaccacgtggaattgaaaaaatgtaagtgttcaccagtgaaaacctgtgacttaaaaaggcctggttgcaaccatctgtttcctccagtttcaggaacatgcaagtccctcctctaggtctggctgaacgtctccctctcaacccctctctactgtggcaaattgagtgtgagtttatcagaggctcctaaccttcctctgatataaatggagctcaggcctcccaaactaatgaccttctttccctctttagtgatgtcctctcccctgtagagcaataagacacagccaatttctctatcacatcacaacgtcttctaagttagcctcacgtcagctttctaaactcttgaaaaaataagtcatttccttgtgagagcccaaaagtccattaaatgagatttttccaacataattttcttgggccatccagaaagcttattttaagtttattgttatttaacatttggaggagttatggattactaggtgaacctggaagtgaattgttacatgattattagattaccaaataaatggcaataataggcagaattgtcatggtcctagcattttaaatcagaagtatctgatggactgtgaatttgaatgggacaccctgaacctgggcttctttaaggttaaggttaattgatccctgttacaaccctgaggtggagagctaaggtcctgctggtgccagctcacatcactttagtccagacctccttacccctgaactctctttagggcactgaatccagcacacacaccccttcctgctctgtgacataaaaagaccagtttcaaggtacagtcctctgagaatgcagtgttggggactacatccaacaagaattttagacagtctggctcagtcctgatggaccaaactcaggtgaagccttcacttggctcatagcccctactggagctagaaccattgcttgtcaaatgtcaactggatgccaccatccagcatttaagagaaaggctctgacatttcccaacccctgcaatctttgcttctgttgttcccatcatgaagactccacttgctccactggtctttccctctgagccattacagtggcagctgctgagattacctttaatgtcaccctcaattaacctgacaggatacagtcctctcaaacccctcttgggactaagagaaaataagagacttagggtgggtaactgaaaatgcttttatattcctggctcttctgcaggtaaatctctcagaaaattgctgctttattgtttccaggcactgagctcacattacaccagcccaagcctggaaggctctgtcagcccatccatcagcttttaaggggtgaaaacctttgggaaacatggaaaccactcaacttggaaacattaatgaaatggttcaagtaaacaccaaatcttcatgcctggatgttaccttccaatttcttctttcagataaaaacaacatgaaactatattgcaatagaaataagcaggaaaaaaaaccagaaaggaaatgtgtgtttgtgcgtgtatacacaggacacagagccaaaagcatggggaattttccaaaggaaatgaaaatgtagttcctgtcaacctttctcagagaagccattctttcctctctggaagctggaccgtatacaaccagaagcattactgtctttaccaaagtaatagggtgttggatatttctccatatacaaatgagttttattacttaattgcttatttttcaagtatacaatatttgagtaacattaattgctcagaaagcaacattgacaatttaaccaaaagacaagaaaggaatctcgctagctagttcaatcttctttcaagtttggaacatgttaagcaaattttatgatacctaatagattatggactattatctcactgaattatattaatcactataagaccaagagatagtatgtacatatttagctcatgaaagtataagatacccagttaattttggttttaaatgaataacaggtaatttttagtataatcaacaaacattgtgtggaatatatactatacaagaaaaatgtatctgaaattcaattttaactggccatattgtattttatttggcaatcccacaaaaagaccagttttacccaaaatgcttctagtgtctgtatgcatcagtacttaccaaacaacgtggcttgccctttagaaaccaactgtttcttaacaattgacctaaccatttggatgtcatcgaggaatatatttagaaaaaaatgagaatgaaggttgaatatgttgtcctttctcatccagatgtcgatgtcatagtttcctgctctttaatccttattctatttttctaataataaagattagataagtgctttttcctagaaggaccccttgaccacagtcaatttcttaatcattctgaaatagaaacttgaacatgtactgaaaaaaacaatatgagaaacaagaattttatgccgatattttgaattggctaattgtgtctggaaatttattgattttttttttcaaaaataagatttccaaattaggcaagtgatagtgtttcatttaacgacaaggagttgaaattgactttgattttcaaatgctttttctcactcttgttaaagttttctaaagattgtcttcattctaagaaattaatatttctagcttcccattaaaaagaaaaaacatatttttgacttgtaaaattattatcatatttaaaaactatcttccaaaatatttctgaggacattatgtttattgagtgaaacttgtgttaggtggaactataccactcttcgttagagttgatcaaatatgattgagtacaaaatatcctaaaacttacaacaatatagaatccaatgatttttttaaaatttattattattatactttaagttttagggtacatgtgcacaaagtgcaggttagttacatatgtatacatctgccttgctggtgcgctgcacccactaactcgtcatctagcattaggtatatctcccaatgccatccctcccccctccccccaccccacaacagtccccagagtgtgatgttcctcttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcgtcttttatagctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgcttcctgactttttaatgattgcctttctaactggtgtgagatggtatctcattgtggttttgatttgcattcctgtgatggccagtgatggtgagcattttttcatgtgttttttggctgcataaatgtgttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggcttttgttgccatggcttttggtgttttagacatgaagtccttgcccatgcctatgtcctgagtggtaatgcctaggttttcttctagggtttttatggttttagatctaacgtttaagtctttaatccatcttgaattgatttttgtataaggtgtaaggaagggatacagtttcagctttctccatatggctagccagttttcccaccaccatttattaaataggggatcctttccctattgcttatttttctcaggtttgtcaaagatcagatagttgtagatatgcagcattatttctcagggctctattctgttccattgatctatatctctgttttggtaccagtaccatgctgttttggttactgtagccttgtagtatagtttgaagtcaggtagtgtgatgcctccagctttgttcttttggcttaggattgacgtggcgatgcgggctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttgtagacatacaatcatgtcatctgcaaacagggacaatttgacttcctcttttcctaattgaataccctttatttccttctcctgcttaattgccctggccaaaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggccttttctgcatctattgagataatcatgtggtttttgtctttggtctgtttatatgctggattacatttattgatttgcgtatattgaaccagccttgcatcccagggatgaagcccacttgatcatggtggataagctttttgatgtgctgctggattcagtttgccagtattttattgaggatttttgcatcaacattcatcaaggatattggtctaaaattctcttttttggttgtgtctctgcccggctttggtatcaggatgatgctggcctcataaaatgagttagggaggattccctctttttctattgattggaattgtttcagaaggaatgttaccagttcctccttgtacctctggtagaatttggctgtgaatccatctggtcctggactctttttggttggtaagctattgattattgccacaatttcagagcctgttattggcctattcagagattcaacttcttcctggtttagtcttgggagggtgtatgtgtcaaggaatttatccatttcttctagattttctagtttatttgcatagaggtgtttgtagtattctctgatggtagtttgtatttctatgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctactagcttttgaatgtgtttgctcttgcttttctagttcttttaattgtgatgttagggtgtcaattttgaatctttcctgctttctcttgtgggcatttagtgctataaattttcccctacacactgctttgaatgcatcccagagactctggtatgttgtgtctttgttctcgttggtttcaaagaacatctttatttctgccttcatttcgttatgtacccagtagtcattcaggagcaggttgttcagtttccatgtagttgagcagttttgaatgggattcttaatcttgagttctagttttattgcactgtggtctgagagatagtttgttataatttctgttcttttacatttgctgaggagagctttacttccaagtatgtggtcaattttggaataggtatggtgtggtgctgaaaacaatgtatattctgtttatttggggtggagagttctgtagatgtctattaggtctgcttggtgcagagctgagttcaattcctgggtatccttgttaactttctgtctcattgatctgtctaatgttgacagtgggatgttaaagtctcccattattaatgtgtgggagtctaagtctctttgtaggtcactcaggacttgctttatgaatctgggtgctcctgtattgggtgcatatatatttaggatagttagctcttcttgctgaattgatccctttaccattaggtaatggccttctttgtcccttttgatctttgttggtttaaagtctgttttatcagagactaggattgaaacccctgccttttattgtttaccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaaggtaatattgttatgtgtgaatttgatcctgtcattatgatgttagctggttattttgctcgttagttgatgcagtttcttcctagtctcaatggtctttacattttggcatgattttgcagtggctggtagcagttgttcctttccatgtttagcgcttccttcaggagctcttttaaggcagggctggtggtgacaaaatctctcagcatttgcttatctgtaaagtattttatttctctttcacttatgaagcttaatttggctggatatgaaattctgggttgaaaattcttttctttaagaatgttgaatattggcccctactttcttctggcttgtagggtttctgccgagagatccgctgttaatctgatgggcttccctttgtaggtaaccagacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcactttcaggtacaccgatcagacgtagatttggtcttttcacatagtcccatatttcttggaggctttgctcatttctttttattcttttttctgtaaacttcccttctcgcttcatttcattcatttcgtcttccatcgctgataccctttcttccagttgaccacatcagctcctggggcttctgcattgttcacgtagttctcgagccttggttttcagctccatcagctcctttaagcacttctctgtattggttattctagttatacattcttctaaatttttttcgaagttttcaacttctttgcctttggtttgaatgtcctcccgtagctcggagtaatttgatcgtctgaagccttcttctctcagctcgtcaaagtcattctccatccagctttgttccattgctggtgaggagctgcgttcctttggaggaggagaggtgctctgctttttagagtttccagtttttctgctctgttttttcccatctttgtggttttatctacttttggtctttgatgatggtgatgtacagatgggtttttggtgtggatgtcctttctgtttgttagttttccttctaacagacaggaccctcagctgcaggtctgttggaatacccggccatgtgaggtgtcagtctgcccctgctggggtgcctcccagttaggctgctcggggatcaggggtcagggacccacttgaggaggcagtctgcccgttctcagatctccagctgcgtgctgggagaaccactgctctcttcaaagctgtcagacagggacatttaagtctgtagaggttactgctgtctttttgtttgtctgtgccctgcccccagtggtggagcctacagaggcaggcaggcctccttgagctgtggtgggctccacccagtttgagcttcctggctgctttgtttacctaagcaagcctgggcaatggcgggcacccctcccccagcctcgctgctgccttgcagtgtgatctcagactgctgtgctagcaatcagcgagactctgtgggcataggaccctctgagccaggtgcaggatataatctcctggtgcgccgttttttaagctcgtcggaaaagcgcagtattcgggtgggagtgacccgattttccaggtgccgcctgtcacccctttctttgactaggaaagggaactccctgaccccttgcgcttcccgagtgaggcaatgcctcgccctgcttcggctcgcgcatggtgcacacacccactgacctgcacccactgtctggcactccctagtgagatgaacccggtacctcagatggaaatgcggaaatcaccggtcttctgcatcgctcatgctgggagctgtagaccggagctgttcctatttggctatcttggctcctcccc

SEQ ID NO: 12505 - DNA, 5089 bp, Homo sapiens
tttcatttattcatttttttttattattatactttaagttttagggtacatgtgcacaacgtgcaggtttgttacatatgtatacatgtgccatattgttgtgctgcacccattaactcgtcatttagcattaggtgtatctcctaatgctatccctcccctctcccccaccccacaacagtccccagtatgtgatattccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtccttatagcagcatgatttatagtcctttgggtatatacccagtaatgggatggctgggtcaaatggtatttctagttctagatccctgaggaatctccacaccgacttccacaatagttgaactagtttacagtcccaccaacagtgtaaaagtgttcctatttctccacatcctctccagtacctgttgtttcctgactttttaatgatggccattctaactggtgtgagatggtatctcattgtggttttgatttgcatttctctgatggccagtgatgatgaacattttttcatgtgtcttttggctgcataaatgtcttcttttgagaagtgtctgttcatatcctttgcccactttttgatggggttgtttgtttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggctttaggtctaacatgtaagtctttaatccatcttgaattactttttgtataaggtgtaacgaagggatccagtttcagctttctacatatggctagccagttttcccagcacaatttattaaatagggaatcctttctctgctgcttctttttgtcaggtttgtcaaagatcagatagttgtagatatgcagcattatttctgaaggctctgttctgttccattggtctatatatctgttttggtaccagcaccatgctgttttggttactgtagccttgtagtttagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttgttccatttgtttgtatcctcttttatttcgttgagcagtgttttgtagttctccttgaagaggcccttcacgtcccttgtaagttggattcctaggtattttattctctttgaagcaattgtgaatgggagttcactcatgatttggctctctgtttttctgttattggtgtataggaatgcttgtgatttttgcacactgattttgtatcctgagactttgctgaagttgcttatcagcttaaggagattttgggctgagacgatggggttttctacatatacaatcatgtcatctgcaaacagggacaatttgacttcctctgttcctaattgaataccctttattcccttctcctgcctgattgccctggctagaacttccaacactatgttgaataggagtggtgagagaggacatccctgtcttgtgccagttttcaaagggaatgcttccagtttttgtccattcagtaggatattggctgtgggtttgtcatagatatctcttattattttgagatacgtcccatcaatacctaatttattgagagtttttttagcatgaagagttgttgaattttgtgaaaggccttttctgcatctattgagataatcatgtgttttttgtcttttgttctgtttatgtgctggattacgtttattgattttcgtatgtcgaaccagccttgcatctgagggatgaagcccacttgatcgtggtggataagctttttgatgtgctgctggatttgctttgccagtattttattgaggatttttgcatcaatgttcatcaaggatattggtctaaaattctcttttttggttgtgtctctgcacgactttggtatcaggatgatgctggcctcataaaatgagtcagggaggattccctctttttctattgattggaatagtttccgaaggaagggtaccagttcctccttttacctctggtagaattcggctgtgaatccatctggtcccggactctttttggttggtaagctattgattatttccacaatttcagagcctgttattggtctatttagagattcaacttcttcctggtttagtcttgggagggtgtatgtgttgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttcctagcagtctatcaattttgttgatcatttcaaaaaaccagctcctggattcattaattttttgaagggttttttgtgtctctatttccttcagttctgctctgattttagttatttcttgccttctgctagcttttgaatgtgtttgctcttgcttttctagttcttttaactgtgatgttagcgtgtaaattttggatctttcctgctttctcttgtgggcatttagtgctataaatttccctctacacactgctttgaatgtgtcccagagattctggtatgttgtgtctttgttctcgttggtttcaaagaacatctttatttctgcctttattttgttatgtacccagtagtcattcaggagcaggttgtttagtttccatgtagttgagaggttttgagtgagtttcttaatcctgagttctagtttgattgcactgtggtctgagagacagtatgttataatttcggttcttttaaatttgctgaggagtgctttacttccaactatgtggtcaattttggaataggtgtggtgtggtgctgaaaaaaacgtatattctgttgatttggggtggagagttctgtagatgtctattaggtccgcttggtgcagagctgagttcaattcctggatatccttgttaactttctgtctcattgatctgtctaatgttgacagtagggtgtgaaagtctcccattgttattgtgtgggagtctaagtctctttgtaggtcactaaggacttgctttatgaatctgggtgctcctgtattgagtgcatatatatttaggatagttagttcttcttgttgagttgatccctttaccatatgtaatggccttctttgtctcttttgatctttgttggtttaaaatctgttttatctgagactaggattgcaacccctgcctttttttgttttccatttgcttggtagatcttcctccatctctttattttgagcctatgtgtgtctctgcatgtgagatgggtttcctgaatacagcacactgatggatcttgactctttatccaatttgccagtctgtgccttttaattggagcatttagcccatttacatttaaggttagtattgttatgtgtgaatttgatcctgtcattatgatgttagctggttattttgctcgttagttgatgcagtttcttcctagccttgatggtctttacaatttggcatgtttttgcagtggctggtacaagttgtccctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaacccgacctttctctctggctgcctttaatattttttccatcatttcgactttggtgaatctgacaattatgtgtcttggagttgctcttctggaggagtatctttgtggcgttctctgtatttcctgaatctgaatgttggcctgccttgctagattggggaagttctcctggataatatcccgcagagtgttttccaacttggttccattctcctcatcactttcaggtacaccagttagacatagatttggtcttttcacatagtcccatatttcttggaggatttgttcgtttctttttactcttttttctctaaacttcttttcatgcttcatttcattcatttcattttccatcactgataccctttcttccagttgatcacatcagttactgaggcttatgcattcatcacgtagttctcgtgctgtggttttcagctccatcaggtcctttaagcacttctctgcattgattattctagttatccattcgtctaatttgttttcaaagtttttaacttctttgcctttggtttgaacttcctcctttagctcagagtagtttgatcttctgaagccttcctctctcaactcatcaaagtcattctccgtccagctttgttctgttgctggtgtggagctgcattcctttggaggaggagaggtgct

SEQ ID NO: 12506 - DNA, 13859 bp, Homo sapiens
agggaggagccaagatggccgagtaggaacagccccggtctacagctcccagcatgagcgacgcagaaggcaggtgatttctgcatttccatctgaggtaccaggttcatctcattagggagtgccagacagtgggtgcaggtcagtgggtgagcacaccacgtgcaagctgaagcatggtgaggcattgcctcactcgggaagcgcaaggggtcagggagttccctttcctagtcaaagaaaggggtgacagacggcacctggaaaatcaggtcactcccacccgaatactgcacttttccgatgggcttaaaaaacggcgcaccaggagattatatcccgcatttggctcaaagggtcctacgcccacggagtctcactgattgctagcacagcagtctgagatcaaactgcaaggcggcagcgaggctgggagaggggcgcccgccattgcccaggcttgcttaggtaaacaaagcagccgggaagctcgaactgggtggagcccaccacagcttaaggagggctgcctgcctctgtaggctccacctctgggggcagggcacagacaaacaaaaagacagcagtaacctctgcagacttaaatgtcccagtctgacagctttgaagagagcagtggttctcctagcacacagctggagatctgagaatgggcagactgcctcctcaagtgggtccctgacccctgacccccgagcagcctaactgggaggcaccccccaacaggggcagactgacacctcacgtggccgggtactccaacagacctgcagctgacggtcctgtctgttagaaggaaaactaacagaaaggacatccacaccaaaaacccatctgtacatcaccatcatcaaagaccaaaggtagataaaaccacaaagatggggaaaaaacagagcagaaaaacgggaaactctaaaaagcagagcgcctctcctcctccaaaggaacgcagttcctcaccagcaacagaacaaagctggacggagaatgactttgatgagctgagagaaggcttcagacaatcaaattattccgagctatgggaggacattcaaaccaaaggcaaagaagttgaaaactttgaaaaaaatttagaataatgtataactagaataaccaatacacagaagtgcttaaaggagctggtggagctgaaaaccaaggctcgagaactacgtgaagaatgcagaagcctcaggagctgatgcgatcaactggaagaaagggtatcagtgatggaagatgaaatgaatgaaatgaagtgagaagggaagtttagagaaaaaagaataaaaagaaatgaacaaagcctccgagaaatatgggactatgtgacaagaccaaatctacatctcatttgtgtacctgaaagtgacggggtgaatggaaccaagttggaaaacactctgcaggatattatccaggagaacttccccaatctagcaaggcaggccaacgttcagattcaggaaatacagagaacgccacaaagatactcctcgagaagagcaaccccaagacacataattgtcagattcaccaaagttgaaatgaaggaaaaaatgttaaaggcagccagagagaaaggtcgggttaccctcaaagggaagcccatcagactaacagcagatctcttggcagaaactctacaagccagaagagagtggggaccaatattcaacattcttaaagagaagaattttcaacccagaatttcatatccagccaaactaagcttcataagtgaaggagaaatacaatactttacagacaagcaaatgctgagagattttgtcaccaccaggtctgccctaaaagagctcctgaaggaagcgctgaacatggaaaggaacaaccggtaccagccactgcaaaatcatgccaaaatgtaaagaccattgagactaggaagaaactgtatcaactaacgagcaaaataaccacttaacatcataatgacaggatcaaattcacacataacaatattaactttaaatgtaaatggactaaatgctccaattaaaagacacagattggcaaattggttaaagagtcaagacccatcagtgtgctgtattcaggaaacccatctcacaggcagagacacacatgggctcaaaataaaaggatggaggaagatctaccaagcaaatggaaaacaaaaaaatgcagggattgcaatcctagtctctgataaaacagactttaaaccaacaaagatcaaaagagacaaagaaggccattatttaatggtaaagggatcaactcaacaagaagagctaactatcctaaatatatatggacccaacacaggagcacctagattcataaagcaagtcctgagtgacctacaaagagacttagactcccacacgttaataatgggagactttaacaccccactgtcaacattagacagatcaatgagacagaaagtcaacaacgatacccaagaattgaactcagctctgcaccaagtggacctaatagacatctacagaactctccaccccaaatcaacagaatatacatttttttcagcaacataccacacctattccaaaattgaccatatacttggaaataaacctctcctcagaaaatgtaaaagaacagaaattataacaaactgtctctcagaccacagtgcaatcaaactagaactcaggattaagaatctcactcaaaaccactgaactacatggaaactgaacaacctgcttctgaatgactactgggtacataacgaaatgaaagcagaaataaagatgttctttgaaaccaatgagaacaaagacacaacgtaccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaccccttcaaaaaattaacgaatccaggagctggttttttgaaaggatcaacaaaattgatagaaagctagcaagactaataatgaaaaaaagagagaagaatcaaatagacgcaataaaaaatgataaaggggatatcaccaccgatcccacagaaatacaaactaccatcagagaatgctacaaacacctctatgcaaataaactagagaatctagaagaaatggataaattcctcgacacatacaccctcccaagactaaacaaggaagaagttgaatctctgaatagaccaataacaggctctgaaattgtggcaataatcaatagcttaccaatgaaaaagagtccaggaccagatggattcacagtcgaattctaccagaggtacaaggaggaactggtaccattccttctgaaactattccaatcaatagaaaaagagggaaccctccctaactcattttatgaggccagcatcattctgataccaaagccgggcagagacacaaccaaaaaagaattttagaccaatatccttgatgaacattgatgcaaaaatcctcaataaaatactggcaaacggaatccagcagcacatcaaaaagcttatccaccatgatcaagtgggcttcatccctgggatgcaagcctggttcaatatacacaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatattgaatgggcaaaaactggaagcattccctttgaaaactggcacaagacagggatgccctctctcaccactcctattcatcagagtgttggaagttctggccagggcaattacataggagaagggaataaagggtattcaattaggaaaagaggaagtcaaattgtccctgtttgcagacgacatgattgtatatctagaaaaccccattgtctcagcccaaaatctcctcaagctgataagcaacttcagcaaagtctcaggatacaaaatcaatgtacaaaaatcacaaccattcttatacaccaacaacagacaaacagagagccaaatcatgagtgaactcccattcacaattgcttcaaagataataaaatacctaggaatccaacttacaagggacgtgaaggaactcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgctgtacccatcaagctaccaatgactttcttcacagaattggaaaaaaactactttaaagttcatatggaaccaaaaaagagccctcatcgccaagtcaatcctgagtcaaaagaacaaagctggaggcatcacactacctgacttcaaactatactaaaaggctacagtaaccaaaacagcatggtactggtaccaaaatagagatatagatcaatggaacagaacatagccctcagaaataacaccacatttctacaactatctgatctttgagaaacctgagaaaaacaagcaatggggaaagtattccctatttaataaatggtgctgggaaaactggctagccatatgtagaaagctgaaactggatcccttccttacaccttatacaaaaatcaattcaagatggattaaagacttaaacgttagacctaaaaccataaaaaccccagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatcttcgcaacctactcatctgataaagggttaatatccagaatctacaatgaactcaaacaaatttacaagaaaaaaacaaacaaccccatcaaaaagtgggcaaaggacatgaacagacacttcttaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaatcattgtggaagtcagtgtggcgattctcagggatctagaactagaaataccatttgacccagccatcccattactgggtatatacccaaagggctataaatcatgctgctataaagacacatgcacacatatgtttattgcggcattattcacaatagcaaagacttggaaccaaccaaaatgtccaacaatgatagactggattaagaaaatgtggcacatatacagcatggaatactatgcagccataaaaaatgatgagttcatgtcctttgtagggacatggatgaaattggaaatcatcattctcagtaaactatcgcaagaacaaaaaaccaaacactgcatattctcactcataggtgggaactgaaaaatgagaacacatggacacaggaaggggaacataacactctggggactgttgtggggtggggggaggggggagggatagcactgggagatatacctaaggttagatgacgagttagtgggtgcagcgcaccagcatggcacatgtatacatatgtaactaaactgcacattgtgcacaggtaccctaaaacttaaagtatatatataaaaaaagtattgcctcgtgggtaaccactgttacccggtgggtaataagtattgcctcgtgggtaaccactgtcacccggtggataataagtattgcctcatgagtaatcactgttacccagtggataataagtattgcctcatgggtaaccgatgttacccggtggataataagtattgtgtcgtgggtaaccgctgttacccagtggataataagtattgcctcgtgggtcactactgttacccggtggataataaatattgccttgtaggtaactactattacgtactggataataaatattgcctcataggtaacagctactattacctaatagataataattatactttatatataatatataatttaataatatgtaagaattgtatagtataatattattatattgtaaatataatgtaatatataaattatatattataataaaatatattataatttattatgttataaataaaatttatcatataatatataataaataaatgatcatatatacatattatatatgtatatgtatatatgtataatatatatgtatatgtgtatatatgtataatatatatgtatatatactatatatgtatattatccaccaccaccaccaatacttattatccactgggtaacataatagaatatataatatataaatattatatattacatatagttatatatgatataaatataaatatacatatataattttatataatataaatataaatatataatatataatttataagagttatacattatatatactatataatactccataatatatattatagtattttattttatattatattttgctatatatttattatatatgtatatatttgttatatatttacatatatcatatatttattgtatattgatgtatatatttatattttatatatatttatatataataaatgtaaataataaatgtaaaataaatatatagtatatatatttatatatataaatttatatatttatataatataatataatatatataatatataatatatataaaatatattataatatatcatatattatataattatatattatatattatataattatatataattatatattatatatatataatttataataatatattataaaattatataattatataatatataattatataattatatattatataattttatgtaatacaatattatattttatataattatataataatatatattatatgatattttatataattatatattatatattatatatttttatataatatataataatatatattatataatatataatgtaatattttattatataattgcattattattttatattttgttttttataatttatcttttatgtattttatatattttacattatattttatataatttatatttcatatattattttatatatttggtattttattttatataatttatatgattatattttattatgtataaacatgtatattacattatatatataaatatatgtaacatataatatataatatataagaatgttatatagtattatgttatattataaaattctaatgtaataaaatatataattatattatgtggtattacattttattatatgattatattatatatactatataatatattatgtattatattatatattatatattatattttattatatgttatatacaatatagtatagtatacaatgtatattttttcttttttttattttagtattattatacttcaagttttagggtacatgtgcacaatgtgcaggttagttatccatatatacatgtgccatgcttgtgtgctgcacccattgactcgtcatttagcattaggtatatctcataatgctatccctcccaccctgcccccagcccacaactgtccccagagtgtgatgttccccttcctgtgtccatgtgttctcattgttcaattcccacctatgagtgagaacatgtggcgtttggttttttgtccttgcgattgtttactgagaatgatgatttccaatttcatccatgtccctagaaaggatgtgaactcaccattttttatggctgcatagtattccatggtgtatatgtgccacattatcttaatccagtctatcatttttggatattggggttggttccaagtctgctattgtgagtagtgccacaataaacatatgtgtgcatgtgtctttatagcagcatgatttatagccctttgggtatatacccagtaatgggatggctgggtcaaatggtatttctagttctagatccctgaggattcgccacactgacttccacaatgattgaactagtttacagttccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatagagttgtttgttattttcttgtaaatttgtttgagttcattgtagattctggatattagccctttgtcagatgagtaggttgtgaagattttctcccattttgtaggttgcctgttcactctgatggtagtttcttttgctgtgcagcagctctttagtttagttagatcccacttgtcaattttggcttttgttgctattgcttttggtgttttagacatgaagtccttgcccatgcctatgtcctgaatggtattgcctaggttttcttctagggtttttatggttttaggtctaacatttaagtctttaatacattttgaattaatttttgtataaggtgtaaggaagggatccagtttcagctttctacatatcgctagttggttttcccagcaccatttattaaatagggaatactttccccattgcttgtttttctcaggtttctcaaagatcagatagttgtagatatgtggcattatttctgagggctctgttctgttccattgatgtatatctctgttttggtatcagtgctatgctgttttggttactgtagccgtgtagtatagtttgaagtcaggtagtgtgatgcctccagctttgttcttttggcttaggatgaacttggtgatgagggcccttttttggttccatatgaactttaaagtagttttttccaattctgtgaagaaagtcattggtagcttgatggggatggcattgagtctataaattaccttgggtagtatggccattttcacgatattgattcttcctacccatgagcatggaatgttcttccatttgtttgtatcctcttttatttccttgagcagtggtttgtagttctccttgaagagttccttcacgtcccttgtaagttggattcctaggtattttattatctttgaagcaattgtgaatgggagttcactcatgatttggctctctgtttgtctgttgttggtgtataagaatggttgtgatttttgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcgtaattgccctggccagaacttccagcactctgatgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcctgaagtattgttgaattttgtcaaaggccttttctgcatctattgagataatcatgtggtttttgtctttggttctgtttatatgctggattacatttattgatttgcatatattgaaccaggcttgcatcccagggatgaagcccacttgatcatggtggataagctttttgatgtgttgctgtattcggtttgccagtattttatcgagaatttttgcatcaatgttcatcaaggatattggtctaaaattctcttttttggtggtttctctgcccgtctttggtatcaggatgatgctggcctcataaaatgagttagggaggattccctctttttctattgattggaatagtttcagaaggaacggtaccagttcctccttgtacctctggtagaattcgactgtgaatccatctggtcctggactctttcgttggtaagctattgattattgccacaatttcagagcctgttattggtctattcagagattcaacttcttcctggtttagtcttaggagggtgtatgtgtcgaggaatttatccattttttctagattctctagtttatttgcgtagaggtgtttgtagtattctctgatggtagtttgtatttctgtgagatcggtggtgatatcccctttatcattttttattgcgtctatttgattcttctctctttttttctttattagtctgctagcggtctatcaattttgttgatcctttcaaaaaaccagctcctggattcgttaattgtttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtacgttgtgtctttgttctcattgatttcaaagaacatctttatttctgccttcatttcgttatgtacccagcagtcattcaggagcaggttgttcagtttccatgtagttgagtagttttgagtgagtttcttaatcctgagttctagtttgattgcactgtggtctgagagacagtttgttataatttctgttcttttacattttctgaggagaggtttatttccaagtatatggtcaattttggaataggtgtggtgtgttgctgaaaaaaatgtatattctgttgatttggggtggagagttctgtagatgtctattaggtccacttggtgcagagctgagttcaattcctgggtatcgttgttgactttctgtctcattgatctgtctaatgttgacagtggggtgttaaagtctcccattattaacgtgtgggagtctaagtctctttgtaggtcactcaggacttgctttatgaatctaggtgctcctgtattgggtccatatatatttaggatagttagctcttcttgttgagttgatccctttaccattaagtaatggccttctttgtctcttttgatctttgttggtttaaagtctgttttatcagagactaggattgcaatccctgcatttttttgttttccatttgcttggtagatcttcctccatccttttattttgagcccatgtgtgtctctgcctgtgagatgggtttcctgaatacagcacactaatgggtcttgactctttatccaatttgccagtctgtgtcttttaattggagcatttagtccatttacatttaaagttaatattgttatgtgtgaatttgatcctgtcattatgatgttaagtggttattttgctcgttagttgatacagtttcttcctagtctcaatggtctttacattttggcatgattttgcagtggctggtaccggttgttcctttccatgttcagcgcttccttcaggagctcttttagggcagacctggtggtgacaaaatctctcagcatttgcttgtctgtaaagtattgtatttctccttcacttatgaagcttagtttggctggatatgaaattctgggttgaaaattcttctctttaagaatgttgaatattggcccccactctcttctggcttgtagagtttctgccaagagatctgctgttagtctgatgggcttccctttgagggtaacccgacctttctctctggctgcccttaacattttttccttcctttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattcaccccgtcactttcaggtacaccaatgagatgtagatttggtcttgtcacatagtcccatatttctcggaggctttgttcatttctttttattcttttttctctaaacttcccttctcgcttcatttcattcatttcgtctttcatcactgatacactttcttccagttgatcacatcagctcctgaggcttctgcattcttcatgtagttctcgagccttggttttcagctccatcagctcctttaagcacttctctgtattggttattctagttatccattcgtctaaattttttttcaaagtttttaacttctttgccttcggtttgaatttcctcctgtagctcagagtagtttgattgtctgaagccttcttctctcaactcatcaaagtcattctccgtccaactttgttccattgctggtgaggaactgtgttcctttcgaggaggagaggtgctctgctttttagagtttcccgtttttctgctctgttttttccccatctttgtggttttatctacttttgtctttgatgatggtgatgtacagataggtttttggtgtggatgtcctttctgtttgttagttttctttctaacagacaggaccgtcagctgcaggtctgttggtgtttgctagaagtctactccagaccctgtttgcctgggtaacagcagcagtgtctgcagaacagcggattttcgtgaaccgtgaatgctgctgtctgattgttcctctggaagttttgtctcagtggagtacccagccgtgtgaggtgtcagtctgcccctactggggggtgcctcctagttaggctgcttgggggtcaggggtcagggacccacttgaggaggcagtctgcccattttcagatctccagctgtgagctgggagaaccactgctctcttcaaagctgtcagactgggacatttaagtttgcagaggttactgctgtctttttgtttgtctgtgccctgcccccagaggtggagcctacagaggcaggcagccctccttgagctgtggtgggctccacccagttcgagcttcccggctgctttgtttacctaagcaagcctgggcaatggtgggcacccctcccccagcctcactgccgcctttcagtttgatctcagactgctgtgcgagcaatcagcgagactctgtgggcataggaccctccgagccaggtgcaggatataatctcctggtgcaccgttccttaagcccgtcggaaaagtgcagtattagggtgggagtgacccgattttccaggtgccgtctgttacccctttctttgattaggaaagggaactccctgaccccttgcgcttcctgagtgaggcaatgccatgctctgcttcggctcatgcacgctgcgctgcccccactgtcctgtgcccactgtctggcactccctagtgagatgaacctggta

SEQ ID NO: 12507 - DNA, 5846 bp, Homo sapiens
ttgtttatcttttattttattttattttattttatttttttaaaattttttttattattatactttaagttttagggtacatgtgcacattgtgcaggttagttacatacgtatacatgtgccatgctggtgtgctgcacccactaactcgtcatctagcattaggtatatctcccagtgctatcccacccccctccccccaccccacaacagtccccagagtgtgatgttccccttcctgtgtccatgtgatctcattgttcacttcccacctataagtgagaatatgcagtgtgtggttttttgttcttgtgatagtttactgagaatgatgatttccaatttcatccatgtccctacaaaggacatgaactcatcattttttatgggtgcatagtattccatggtgtatatgtgccacattttcttcatccagtctatcattgttggacatttgggttggttccaagtctttgctattgtgaatagtgccactataaatatatgtgtgcatgtgtctttatatcagcatgatttatagtcatttgggtatatacccagtaatgggatggctgggtcaaatggtatttccagttctagatccctgaggaattgccacactgacttccacaatggttgaactagtttacagtcccaccaacagtgtcaaagtgttcctatttctccacatcctctccagcaccggttgtttcctgactttttaatgattgccattctaactggtgtgagatggtatcttattgtggttttgatttgcatttctctgatggccagtgatgatgagcattttttcatgtgttttttgtctgcataaatgtcttcttttgagaagtgtctgttcatgtcctttgcccactttttgatggggttgtttgtttttatcttgtaaatttgttggagttcattgtaggttcgggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattccttttggtgttttagacatgaagtccttgcccatgcctatgtcatgaatggtaatgcctaggttttcttctagggtttttatggttttaggtctaacgtttaagtctttaatccatcttgaattgatttttgtataaggtgtaaagaagggatccagtttcagctttctacatatggctagccagttttcccagcacaatttattaaatagggaatcctttccccattgcttgtttttcccaggtttgtcaaagatcagatagttgtagatatgcagcgttatttctgagggctctgttctgttccattgatctatatctctgttttgttaccagtaccatgctgttttggttactgtagccttgtagtatagtttgaagtcaggtagtgtgatgcctccagctttgttcttttggcttaggattgacttggtgatgcggacttttttttggttccatatgaactttaaagtagttttttccaattctgtgaagaaaggcattggtaacttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttcttctctttgaagcaattgtgaatgggagttcattcatgatttggctctccgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaagcagggacaatttgacttcctcttttcctaattgactaccctttatttccttctcctgcctaattgccctggccagaacttccaacactatgttgaataggagtggtgagagagggcattcctgtcttgtgccagttttcaaagggaatgcttccagtttttgcccattcagtatgatattggctgtgggtttgtcatagatagctcttattattttgaaatatgtcccatcaatacctaacttattgagagtttttagcatgaagggttgttgaattttgtcaaaggcattttctgcatctattgagatattcatgtggtttttgtctttggctctgtttatatgctggattacatttattgatttgcgtatattaaaccagccttgcatcccagggatgaagcccacttgatcatggtggataagctttttgatgtgctgctggattccatttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggaaagctattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcagtggtgatatcccctttatcattttttattgcgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatctctgccttcatttcgttatgtatccagtagttattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggttaattttggaataggtgtggtgtggtgctgaaaaaaatgtatattctgttgatttgaggtggagagttctgtagatgtctattaggtccacttggtgcagagctgagttcaattcctgggtatccttgttgtctttctgtctcgtcgatctgtctaatgttgacagtggggtgttaaagtctcccattattaatgtgtgggagtctaagtctctttgtaggtcactcaggacttgctttatgaatctgggtgctcctgtattggatgcatatgtatttaggatagtgagctcttcttgttgaattgatccctttacctttatgtaatggccttctttgtctcttttgatctttgttgttttaaagtctgttttatcagagactaggattgcaacccctgcctttttttgttttccatttgcttggtagatcttcctccatccttttgttttgagcctatgtgtgtctctgcacgtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttaactggttattttgctcattagttgatgcagtttcttcctagtctcgatggtctttacattttggcatgattttgcagcggctggtaccggttgttcctttccatgtttagcgctcccttcaggagctcttttagggcaggcctggtgtgacaaaatctctcagcatttgcttgtctgtaaagtattttatttcttcttcacttatgaagcttagtttgcctggatatgaaattctgggttgaaaattcttttctttaagaacgttgaatattggcccccactctcttctggcttgtagggtttctgccgagagatccgctgttagtctgctgggcttccctttgagggtaacctgacctttctctctggctgcccttaacattttttccttcatttcaactttggtgaatctgacaatcatgtgtcttggagttgctcttctcgaggagtatctttgtggcgttctctgtatttcctgaatctgaacgttggcctgccttgctagattggggaaattctcctggatactatcctgcagagtgttttccaacttggttccattctccccatcactttcaggtacaccaatcagacgtagatttggtcttttcacatagtcccatatttcttggaggctttgctcacttctttttattcttttttctctaaactttccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctatttttacattcttctaaatttttttcaaagttttcaacttctttgcctttggtttgaatgtcctcctgtagctcagagtaatttgatcgtctgaagccttctctcagcttgccaaagtcattctccgtccagctttgttccgttggtggtgaggagctgtgttcctttggaggaggagaggcgctctgatttttagagtttccagtttttctgttatgttttttccccatctttgtggttttatctacttttggtctttgatgttggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgcttgggggtcaggggtcagggacccacttgaggaggcagtctgcccgttctcagatctccagctgcatactgggagaatcactgctctcttcaaagctgtcagacagggacatttaagtctgcagaggttactgctgtctttttgtttgcctgtgccctgcccccagaggtggagcctacagaggcaggcaggcctccttgagctgtggtgggctccacccagttcaagcttcctggctgttttgtttacctaagcaagcctgggcaatggtgggcgcccctcccccgcagcctcactgccaccttgcagtttgatctcagactgctgtgctagcagtcagcgagactccatggggtaggaccctccaagccaggtgcgggatataatcccgtggtgcgccgttttttaagccagtcagaaaagcgcagtattccggtggaaatgacccgattctccaggtgccctccgtcacccctttctttgattaggaaa

SEQ ID NO: 12508 - DNA, 13972 bp, Homo sapiens
tttttttttttttttttttttttttgtatttttagtagagacggggtttcaccgtgatagccagaatggtcttgatctcctgacctcatgatctgcccgccttggcctcccaaagtgctgggattacaggcgtgagccaccgcacctggccttttttttttttttttttttgagacagggtcttgctgtgctgcccagtctggaatgcggtggcacaatcttggctcactgcaacctctgcctcccaggctcaagccatccttctgcctcagcctcctgactagctgggactacaggcaagtgcctggctaatttttggtattttttgtagaaatggggtttcaccatgttgctcaggctggtctggaactcctggactcaggccatcctcccgccttggtctcccaaagcactgggattataggcgtgagccactgcgcccggccactgtagctcatcttttaaagctgtaatgctccttgctttccttgcttccttctccttttctcttctgtttcaatgagaacaaacttgaaaaccatcagactgaaggccacttcaagaggaatcatggtctggtgtagaagccctaatgctacagactgagtgagccccggcaagcaattttccctctttgggtcttggttttctcatcttttaagccaaagcagtgactcagacctttcttactccacacagttattctggagatccaaagggctcataggtgtgaaatgctttaacttgaataactttccatgttgacatgagggctaactggatccctattccttcatcattggatatcagctggtaacatcctggctggcttttacatctatattgctttccaaaaagagctgtggtatcctataaaataatttatcattgtatctgctatagcaatagggaaatgtactagaatagaagatcgtggccatgggatgtggtgactcagatgtgggtcatgggctctgctgcctcctctgttctctgggaaggactctacttacctcctttcatgcaattttttgtgtccataattgctgcttcttgggccataggtcccattcatacttcctcatagtaaccctgttatttgtcattggtattagccagctccacagtcagcatctcatgagggtaataagaagtgggaaggaccttattttttcctgtactgaattgcctggagagcatctcttgttgattgcagctggaagtgtgacatttagtaagtggagaaacttgaatcaggcaagtggcagcctgtgccagcaggagggtaagaaagggctgaggaagaagggaaatgctcagtggagtaatttggcccaggtgttttcctggctccaggttgggtgttcacattaccacaggtggggattgtagatgctcaaggaattttccattgtgatagaaaccacaaatgagcatgcatagacacctagtttcttctattccatctgacacctgtgttgggaaaataaactccgagaggtaagcacctcacccaaggacttcctgcttttccagtgactagtgcttgagtatgacacaagcctgcattgagatctgtggcttctcaaggcacgggtccagagtgggatgagctggaagggagcttacatcacctctaggcccagtccctcactttataggtggggagacctaggctcaaagagaggccttaacttgataagggattcaggggctgtgctggaactggtgcttagatcattgggacctgattcagagctcttggctgtgcctctccacctatgtgactggatgatgatggttgggttaccctggataaaattaccttcctctcccccagaggctgaaaccacttgtgtccaaactcttgcactttctccatgggtatcatagagatactcatttctagtttatttctaaagagccatctcttccctgcaggtgcattacttctcagagtgatgcctcttccaactcacagcccctgggaacttgagaagtgctgacaatcagcagcagaagacaaatgatgtggggggatcaggaggagggactttgatgggacaggagcctgcaaggaagagggcccacggaggaatttaaaggcagcctggggatggggtgggggaatctggcttctaatacctgttttgtcatttctcaattgtgtgaccttggagaagttacttaatatctctaagccttggtgccctactctgcaaaatggggatggtaacatgtacttcagggttatatgagaatgatatgaaatactgtatttgataatatatattatattatagatgtaatatataagggctaatatatatgaaatatatgtgatatgacagcatcccacggtgcgggatgggcagtaggtgctccacaggagggagtttcttcactcctggcaacagctgcagtgcctggagcacttcctatcttcctccctttgcagagctctctaccctcaagacttctccagttgtgcaggtgacatgttacagtgacaaaggttaagcagtattttttttttttaagaaaaaatggggtatatttattggttcatgtagtttaaccttccagtttctggcatgcctagctccacgggctctaaagatgtcatcaggatgcagtctctccatctctttgccttattctcctccttgttctttccattctcaggcacactctccctgatggagataagagcaaggatgcagacccacattttggtgtcagcagaaagcccagcagaaagaccatcaatagaagtgatattaatatagcattttgtagggggccctggacacctgctttttgcctttgaccatccacctttttctaagtggcccccaggaaaaatatatgcacagaggattataagcattttttcttgcttgggcacggtggcagaaatggctggttggcttccatttttcactctttccttccatggctgcccaactaaagacacatttctatgcctccatttcagcaaagtttaatcatgtaagaatcatgtcacgagatcgtggccaatgaagtatggatgaagtggtagaggatgagatgagtgctgcggaagaaaaggaagaaggcaatagtggtgctgccataccagtcgtagaccacctacctggccgtttgtatgagaaagccatcttatttaacccacttggttaagcctaaccgatacaggcacaaatgcaagccatagcgtcctactgattgagatcagactatacagaagacttctgctgcccaggttggaggctgtcctgggcctggatttggagcttgttggagacaagacagaattttccaaagcaaggaaaattggaacagcttgcctcaggggaattcctgctcttagttggttcagatgtctgtggccaatgaagccttcaggggctggctcgcagaagcctgggaaaagctacaggaatgaaatgaatgcaaagattgtttgacattatttttatcaactcctttacatttactttcccagaaagccttttgaaaccctgttttattatgaaaatattcaaacattcacaaaactagagaaaatacctattcctagattcaacagtgatgaacataatgccatatttgcttcaactttcattcttcctcctccttttctccctccctttttctctctgcccttcttctctctctcttttgttttttcttttggctgtggggttttattttttttttgagacgagtcttgctctgtcacccaggctggaatgcagtggtgcaatctcggctcactgcaagctctgcctcccgggttcatgctattcttgggcctcagcctgctgagtagctggggctacaggtgcccaccaccacgcccggccaattttttgtatttttagtagagatggggtttcactgtattagccaggatggtctcgatctcttgaccttgtgatccgcccgcctcggcctccaaaagtgctgggattacaggtgtgagccaccgcgcacggccagctgtagtctcttaaaggaaacctctggcaatatgtctttgtatccctaaataattctgtatacaattcttaaatataagcatattttcttataggataataccattattacatataataaaattggaagtaattcattgatattatttaatacccaggattaaagctgtattacatttacctagttgtctcaaaactgtgtttttacagtgggtttctgaattaggattcaagccaagtctactcattacatttggttgttacatcaacaaaactttaatgagagctgctgcaacgacaagatctgaaggatagggttattataattctgcctattcttggagagtggacagccagagggaggtaaagaacaacagttctggggatgcacaagccagataatcccatccacaggtccctgatttactcaaagatatgtgatttctttcattttttatgtttgcaataattcattcctggagtggttcgttgaaagtggacagtgtaagggtgagacacttctagcgtctgatttaaatgcagcccttgacttatttaacatatgggttcatttgaaactcactgagctatggcctcttatgtcatgtatgttgagtgcccattatatgccagtactgtttagagacagtacaaaaaatggcaagagaagctagcaaaaaagttcttaattagacggaggacacaggcacgccctttcagctgcagggtgctgtacaggggagtggaaagaaagtgccgtggttaggccgggcgcggtggctcatgcctgtaatcccagcactttgggaggccgaggcgggctgaccacctgaggtcgggagttcaagaccagcctgaccaacatggagaaaccctgtctctactaaaaatacaaaattagccgggtgtggtggcacatgcctgtaatcccagctactagggaggctgaggcagaagaatcgcttgaacctgggaggcggaggttgcggtgagccgagatcgtgccattgcactccagcctgggcagtaagagtgaaactccgtctcaaaaaaaaaaaagaaaaaggaaagtgccatgggcacacaaagggaaggggaagtgtgatcagctcccctgggagaggtcaggagagggtttcctgaagaggtaatcatggtaatgcatgaagaggtaatgcatgttaatattttcctgctagggggaaacgcattccaagcagtgggaacagaataacccaaggcactaaaactctaaaatgcagcgatgatcttgagcagcagtgtttcaagtcacatgatgggtatttgcccccatgaaaataattcagttttgtctacaaaatgtgccttcagatttcaaatacagatgaacatactgtttagaacacattttgacaatgttacctttttaaaaaatctactagggtgtgcaccattcgttcctgccctgcctcccatcccttcccaggccaaacaaacaatattagtttttttttaattttagatatttttatttctccaaatttgttatttatcaggtgtgaatgaaataaaaaatataattgagtcccatcaccatcctcatggaaatggctttaagagaaaactggtcagatgaatattattgcttcccattttcttttcttttcttttcttttctttttttttttttttttgagacagagtctcgctctgttgcccaggctggagtgcagttatgccatcttggctcactgcaacctccgcctcccaagttcaagggattctcctgcctcagcctcctgagtagctgggattacaggcgcgtgccacacgcctggcaaatttgttgtatttttagtagagacagggtttcaccgtgttaaccaggatggtctagatctcctgatctggtgatccatccgcctcggcctcccaaagtgctgggattacaggtgtgagccaccgcacctggcttgcttcctattttcaaccagtaaatagttgctactgataaattgacagccaggagtctgtcaagaatgctcaagatatgttatataatacaacatgactgttcacagtgggggaaatcccaggaaataacttatgtgtacttcttgatttcaccatacaagacaagcacaaaagcaccatccatgcctctgagaacactggaccatgcacccttgaaaaaatctttgcctccttcatcaccaacaatcttcctccagcagtcaagcgtgcctgtgtacatgacgtcaattcctttgcgccctgactgcatcatcatgcggcatcgaacggtgtcaaatggatgggaagtcaacccagcaatggcagtgacagtctgagtgatcatccagctgatgatgatgtgagtgttcctgggatccggaagcattccctttgcagtgtcatagataccaaagtaggcagctcggtagatgataataccctgcacagacacgttaaagccttggtacaggcccttaatcccatcagtttcgtagatcttaaccaggcagttaccgaggcctcagaattccctttcagctccagctttacccacgtcagctgctagacaggtatgggcaaaatcaagagggtacacaaaacacaaggatgtggccccagcggcaccacctgatgccggattccctgcaaagtagctcccaaactgggtcctcttgtccacaccacccaggaagatctgcttgtgtttatctttgaaggccaagttgagagcctgggtggggaagtatctgaggacattgaccaggttacggtgccagaaggacaggactccctgctccttgagaatatggaccacgcagtctataatgcccttgtattgcatatctgcggtgatctgcttgctggcatgctgtacctccagcagcagcttgaccctctcgatgggcgctacccccatcttggagatggctgctgccactccacctgccaggaagtccttggtgaaggacacagcggcatctgtcatgttgaaaggaaagaggaggcaggcggcaggctgctgcaggacgagactgggccgggaactggctttgacgccagggctgcggggaaacaatattagtttttgtcaaattccaaagcttcatttttttcctcaggtccctttataacttcccaatctctcttccttgactgctcaagataaaaccaaaatataatgcgaaaaatatttccattcttttaacaaataaaaacgcctaaatcaattactttttaccttcatggttttggtaatctattcatcatgggtcaatgacacttgatagaaaagtggacttcctatctggtttaaagccaaatcaaggttgtgtcctgaggaattcttgaaactccatgaataaccctgatgcccttagggaggaatgagatgactgagagtgctatcacctgagcagtgggacccagctactttgcgcaatcaactgacaaagtgggtggcctggaactcggaaagtgtgcactcacattctcattcgagtagctctgcaaggctaggacagataggcatgactgtctatgcaacgggcagaggaaatacgtggtgtggtgtcaaagttctgcacttggggacttgtcctggctcacagccaccatcaaagtgatatgaagtaggtgacatttagagtgttttttccttgtgctaggcactgttctaagcatgctattcacaacaactcagtgaagtgggttgtattattcccctcgtatcaatcaagattctccagagaaactgaaccagtaggatgtatgtgtgtacatatttatcaggttgatgcaaaagtaatggcaatttttgccattacttttaatggcaaagactgcagttacttttgcaccaacttaatattatatgtgtgtgtgtatgtatatatatatatatatttatttttttttaatttttttttatttttattttatttttattattatactttaagttttagggtacatgtgcacattgtgcaggttagttacatatgtatacatgtgcaatgctggtgtgctgcacccactaacttgtcatctagcattagatatatttcccagtgctatccctccctgctccctccaccccacaacagcccccagagtgtgatgttccccttcctgtgtccatgtgatctcattgttcaattcccacctatgagtgagaatatgcggtgtttggttttttgttcttgtgatagtttactgagaaggatgatttccaatttcatccatgtccctacaaaggacatgaactcatccttttttatggctgcatagtattccatggtgtatatatgccacattttcttaatccagtctatcattattggacatttggcttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttcatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttgggtctaacgtttaagtctttaatccatcttgaattgatttttgtacaaggtgtaaggaagggatccagtttcagctttctacatatggctagccagttttcccagcaccatttattaaatagggaatcctttccccattgcttgtttttctcaggtttgtcaaagatcagatacttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgacggggatggcattgaatctgtaaattaccttgggcagtatgaccattttcacgatattgattcttcctacccataagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgctttggctctctgtttgtctgttggtgtataggaatgcttgtgatttttgcacattgattttgtatcctgagactttgctgaagttgcttatcagcttaaggagattttgggctgagataatggggttttctagatatacaatcatgtcatctgcaaacagggacaatttgacttcctcttttcctaattgaataccctttatttccttctcctgcctgattgccctggctagaacttccaacactatgttgaataggagtggtgagagagggcatccttgtcttatgccagttttcaaagggaatgcttccagttgttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataaccatgcggtttttgtctttggctctgtttatatgctggattacatttattgatttgcgtatattgaaccagccttgcatcccagggatgaagcccacttgatcatggcggataagctttttgatgtgctgctggatttggtttgccagtattttattgaggatttttgcatcgatgttcatcaaggatattggtctaaaattctcttttttggttgtgtctctgcccggctttggtatcagaatgatgctggcctcataaaatgagtcagggaggattccctctttttctattgattggaatagtttcagaagaaatggtaccagttcctccttgtgcctctggtagaattcggctgtgaatccatctggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttttgtgggattggtggtgatatcccctttatcattttttattgcgtctatttgattcttctctctttctttctttattagtcttgctagcggtctatcaattttgttgatcctttcaaaaaaccagctcctagattcattaattttttgaagggttttttgtgtctctatttccttcagtcctgctctgattttagttatttcttgccttctgctagcttttgaatgtgtttgctcttgcttctctagttcttttaattgtgatattagggtgtcaattttggatctttcctgctttctcttgtgggcatgtagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccactattaatgtgtgggagtctaagtctctttgtaggtcactcaggacttgctttatgaatctgggtgctcctgtattgggtgcatatatatttaggatagttagctcttcgtgttgaattgatccctttaccattatgtaatggccttctttgtctcttttgatctttgttggtttaaagtctgttttatcagagactaggattgcaacctctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctgttattttgctcgttagttgatgcagtttcttcctagtctcgatggtctttacattttggcatgattttgcagcagctggtactggttgttcctttccatgtttagcgcttccttcaggagctcttttagggcaggcctggtggtgacaaaatctctcagcatttgcttgtctgtaaagtattttatttctccttcacttatgaagcttattttggctggatatgaaattctgggttgaaaattcttttctttaagaatgttgaatattggcccccactctcttctggcttgtagggtttctgctgagagatccgctgttagtctgatgagcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagttgattgcattggctcctgaggcttctgcattcttcacatagttcttgagccttggctttcagctccatcagctcctttaaggacttctctgcattggttattctagttatccattcatctaattttttttcacagtttttaacttctttgccattggtttgagtttcctcctgtagctcggagtagtttgatcatctgaagccttcttctctcaactcgtcaaagtcattctccgtccaggtttgttcagttgctggtgaggaactgtgttcctttggaggaggagaggcactctgctttttagagtttccagtttttctgctctgttttttccccatctttgtggttttacctacttttggtctttgatgatggtgatgtacagatgggtttttggtgtggatgtcctttctgtttgttagctttccttctaacagacaggaccctcagctgcaggtctgttggagtaccctgcagtgtgaggtgtcagtgtgcccctgctggagggtgcatcccagttaggctgctcgggggtcagaggtcagggacccacttgaggaggcagtctgccccttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgctgccttgcagtttgatctcagactgctgtgctagcaatcatcgagactccgtggggtaggaccctccgagccaggtgggggatataatctcgtggtgcgccgttttttaagcccgtcggaaaagcgcagtattctggtgggagtgacccgattttcccgattttccaggtgccgtccgtcagccctttctttgattaggaaagggaactccctgaccccttgcgcttcccgagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgctcaggctgggagctgtagaccggagctgttcctattcggccatcttggctcctcc

SEQ ID NO: 12509 - DNA, 6038 bp, Homo sapiens
ttattttattttatttatttatttttttattattataatttaagttttagggtacatgtgcacattgtgcaggttagttacatacgtatacatgtgccatgctggtgtgctgcacccactaactcgtcatctagcattaggtatatctcccagtgctatccctcacccctccccccagcccaccacagtccccagagtgtgatgttccccttcctgtgtccatgtgatctcattgttcaattcccacctatgagtgagaatatgcggtatttggttttttgttcttgtgatagtttactgagaatgatgatttccaatttcatccatgtcactacaaaggacatgaactcatcattttttatggctgcatagtattccatggtgtatatgtgccacattttcttaatccagtctatcattgttggacatttgggttggttccaagtatttgctattgtgaataatgccgcaataaatatacatgtgcatgtgtctttatagcagcatgatttatagtcctttgggtatatacccagtaatgggatggctgggtcaaatggtatttctagttctagatccctgaggaatcgccacattgacttccacaatggttgaactagtttacagtcccaggaacagtgtaaaagtgttcctatttctccacatcctctccagcacctgttgtttcctgacgttttaatgattgccattctaactggtgtgagatggtatctcattgtggttttgatttgcatttctctgatggccagtgatggtgagcattttttcaagtgttttttggctgcctaaatgtcttattttgaaaagtgtctgttcatgtccttcgctcactttttgatggggttgtttgtttttttttcttgtaaattggtttcagttcattgtagattctggatattagccctttgtcagatgagtaggttgcaaaaattgtctcccattttgtaggttgctcttcactctgatggtagtttcttttgctgtgcagaagctctttagtttaattagatcccatttgtcaattttggcttttgttgtcattgcttttggtgttttaaacatgaagtccttgcccatgactatgtcctgaatggtaatgcctaggttttcttctagggtttttatggttttaggtctaacatttaagtctttaatccgtcttgaattgattttttataaggtgtaaggaagggatccagtttcagctttttacatatgtctagccagttttcccagcaccatttattaaatagggaatcctttccccattgcttgtttttctcaggtttgtcaaagatcaggtagttatagatatgcggctttatttctgagggctctgttctgttccactgatctatatctctgttttggtaccagtacaatgctgttttggttactgtagccttgtagtatagtttgaagtcaggtagtttgatgcctccagctttgttcttttggcttaggattgacttggtgacgtgggctcttttttggttccatatgaactttaaagtagttttttccaattctgtgaagaaaggcattggtagcttgatggcgatggcattgaatctgtaaattaccttgggcagtatggccattttcatgatattgattcttcctacccatgagcatggaatgttcttccatttgtttgtatcctcttttatttccttgagcgcggtttgtagttctccttgaagtggtcctgcacatcccttgtaagttggattcctaggtattttattctctttgaagcaattgtgaatgggagttcactcatgatttggatctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagagcatccctgtcttgtgccagttttcaaagggaatgcttccagtttttgcccattcagtatgatattggctgtgggtttgcaatagatagctcttctcattttgaaatatgtcccatcaatacctaatttatggagagtttttagcatgaagggttgttgaattttgtcaaaggccttttctgcatctgttgagataatcatgtggtttttgtctttggctctgtttatatgctggattacatttattgatttgcatatattgaaccagctttgcatcccagggatgaagcccacttgatcatggtggataagctttttgatatgctgctggattctgtttgccagtattttattgaggatttttgcatcaatgttcatcaaggatattggtctaaaattctctttttcggttgtgtctctgcctggctttggtatcagaatgatgctggcctcataaaatgagttaaggaggattccctctttttctattgattggaatagtttcagaaggaatggtagcagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcagtggtgatatcccctttatcattatttattgcatctatttgattcttctctctttttttctttattagtcttgctagcggtctatcaattttgttgatcctttcaaaaaaccagctcctggattcattaattttttgaagggttttttgtgcctccatttccttcagttctgctctgattttagttatttcttgccttctgctagcttttgactgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctccttggtttcaaagaacatctttctttctgccttcatttcgttatgtacccagtagtcattcaggagcaggttgttcagtttccatgtagttgagtggttttgagtgagattcttaatcctgagttctagtttgattgcactgtggtctgagagatagttttttataatttgtgttcttttacatttgctgcggagagctttacttccaagtatgtggtcaattttggaattaggtgtggtgtggtgctgaaaaaaatgtatattctgttgatttggggtggagagttctgtagatgtgtattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgcttaatgaatcttggtgctcctgtattgggtgcatatatatttaggatagttagctcttcttgttgagttgatccctttaccattatgtaatggccttctttgtctcttttgatctttgttggtttaaagtctgttttatcagagagtaggattgcaacccctgccttttttgttttccatttgcttggtagatcttcctccatcctttaattttgagcctatgtgagaatctgcacgtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgatgcagtttattcctagtctcgatggtcattacattttggcatgattttgcagtggctggtaacggttgttcctttctatgtttagtgcttccttcaggagctcttttagggcaggcctggtggtgacaaaatctctcagcatttgcttgtctgtaaagtattttatttctccttcacttatgaagcttagtttggctgaatatgaaattctgggttgaaaattgttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattacgtgtcttggagttgctcttctcaaggagtatctttgtggtgctctctgtatttcctgaatctgaatgttggcctgccttgctagattggggaaattctcctggataatatcctgcagagtgttttccaacttggttccattctccccatcactttcatgtacaccaatcagacgtagatttggtcttttccacatagtcccatatttcttggaggctttgctcgtttctttttattcttttttctctaaactttccttctcgcttcatttcattcatttcatcttccattcctgataccctttcttccacttgatcacctcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcttcctgtagctcagagtaatttgatcgtctgaagccttcttctctcagcttgtcaaagtcattctccatccagctttgttccattgctggtgaggagctgcattcctttggaggaggagaggcgctctgatttttagagtttccagtttttctattctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcctcttctcagatctccagctgggtactgggagaaccactgctctcttcaaagctgtcagacagggacatttaagtctgcagaggttactgctgtctttttgtttgtctgtgccctgcccccagaggtggagcctacagatgcaggcaggcctccttgagctgtggtgggctccacccagttcgagcttcctggctgctttgtttacctaagcaagcctgggcaatggtgggtgcccctcccccagcctcgctgctgccttgcagtttgatttcagactgctgtgctagtaatcagcgagactccgtggggtaggaccctccgagccagatgcgggatataatctggtggtgcgccgttttttaagcccgtcggaaaagcacagtattccggtgggagtgacccgattctccaggtaccgtccgtcacccctttctttgattaggaaagggaactccctgaccccttgtgcttcctgagtgaggcaatgcctcaccctgcttcggctcgcgctcggtgcacacacccactgacctgcgcccactgtctggcactccctagcgagatgaacccggtacctcagatggaaatgcagaaatcacccgtcttctgcgtcgctcatgctgggagctgtagactggagctcttcctattcggccatctt

SEQ ID NO: 12510 - DNA, 11712 bp, Homo sapiens
tttaattatttgtgtcatttttttattattattatactttaagttttagggtacatgtgcacaacgtgcaggtttgttacatatgtatacatgtgccatgttggtgtgctacacccagtaactcgtcatttacattaggtatatctcctaatgctatccctctcctctcccctcaccccacaacagtccctggtgtgtgatgttccccttcctgtgtccaagtgttctcattgttcaattcccacctatgagtaagaacatgtggtgtttggttttttgtccttgtgatagtttgctgagaatgatagtttccagcttcatccatgtccctacaaaggacatgacctcatcattttttatggctgcatagtattccgtggtgtatatgtgccacattttcttaatccagtatatcattgttggacatttgggttggttccaagtctttgctattgtgaataatgccacaataaacatacgtgtgcatgtgtctttatagcagcatgatttataatcctttgggtatctacccagtaatgggatggctgggtcaaatggtatttctagttctagatccctgaggaattgccacacctacttccacagtggttgaactagtttacagtcccaccaacagtgtgtcattgtttagtgtttatgttgcttcttctctgtatcacattctatcttaatgtatcagttttggatcatttgtatttgcctgatacgttcttaagtatttttgttcagttaagttctctgggtgatattctctgatttcttgtataagctcaaatgccaatctgtttttttcttttcctttgtaggtaacatgttctttttgccagactacttgttaagagtttcttttttattgttatgtatattttgttacccgttctttagtttggagcttagtgagttctttattttggaacttagtgactttcagtctacagagtcaaacctttgtgttagggaagaaattttcttgtttcctattattgcctttgcctctattaagtccccttaatcttttattttatgatatatttctttttacattttactttgtgaattgaagtttttttgtacttgttctcttagctaatttcatcttcttttttaattgttcaaattcaatttgagtagataaattatttttaagggttcttcacgtatagatacatacacacaaggtatttttataataaatttaggttattttctttctttttgagctttggagctttattcattcagtgtacatgttctgttttattctgactgttcagaacctatcttttagctgctaagcaaagtatctgcgcttctttgccctttcccctgctgtgttttcttcagtagcccccatgatgcatatggctctgccttgcttgtcttaggtgcacacacccacattaggagccctagtccttctggtcagttgttaaattactttacagggtaattttccagtttttgttagtaccctgggggcaagcatctctcttgttgtggaaaggggtggggtatagcctttgaacttctgtttttctctttaggtcagtatgataccacttgcttttaagtttttcagtcttttagtctttcagaagtgtatcaaagtctgatctctggccttctggtgccattcataccattctgttaaggatttattttttcctatttaacttaatgatttttgagacacttggagaaggagagatttgcttcctcacatatatgcagtctaggattggaagtccactgggaagtttttttcataggttttgagaggaaacttttctgcagggaacattcactgaggcagaatcgtggtgcctttcatgcaatttggtgggtcttaggagtgtgaatggctgcttcagtgtcttcttcagctggcaggtggggtcttccagaaaaaaatagtttaccacatcaggaatgatgaagatatggtcaagcattccacttttcctatctgcaaaacagggcttaaaatagtatatcaaacaataactagttagaagatacaatggaagaaaaagtgccactttcaggagcaacaaagatgagataccagaaataaacttaacaacaaactctaaaacctacatgataaaaatgtaaaacatcattgaagaacataaaagaagtttggaacaattgaagaatatgtcttcttcataactggaaatacacagcaccataaagatgttagtttaaggtaatttataaatttaatgtgatgataagaatcctttttaaaaaactaaataaattgatcttggctaaataatttaaccaagaaactttgtaggaaaaagaaaaagaacaagggtagtggatatagaggacttttgcaactagatgttgtattgtgaagtcttagtctcagtaattaaaacccattggttgtgggacatgaagagaagtattatggggtagaatggaaatcctagaaaatatacccacgttcataggaatatttaggtatggtaaagatggcttctcaaaagccaatggagatgatatgtactattcagtaaatagttttggagaaactgaatattcacctgtggaagtaaagaaaataggaatcctacctcataccaaggatgaattacaaatgatcaaagatttaaatgtactaaatgaaaacataaaaaattttttaaggccgggtgcagtgactcatgtctgtaatcccagcattttgggaggctaaagtggcaggatcccttgaggccaggagtttgaaaccagcctagtcaacatagcaagaccccgtcactacaaaagaaaaataaaaaacttagcctggcatggtggtacctgcctgtagtcccaggtactcaggagactgaagtgggaggatctcttgagcccaggagtttgaggctatagtaagctacgattacaccaccgccctccagccctggaaatagagcgagaccctgtctccagaaaaaaaaaaaaggtaatagaaaacatagagaattaacacaatttttttttataataggaaggcattttgaactatgatttaaagcagtaaaagaaaaagccatgaaggaaagggttgagaaatgaggctacataaaacaaaaaacatctacattacataaaatatctacattacaatatataaaacatctgcattacaaaaaacaaagtaagcaaggacatatgacgacctgggaaaaatacctgaaactcatattacagatgaaggattaatctccttgatatacaaagaactaaaaatggttaaggaaaagtccaacaacccaatagaaaaatgggctaatatataaaaatattttttttactgtagaaaatttgtttttcagatatatttgtacatatatagaatgacatataaatgcacaaacttattgtagcattgtttgtaatagcagtaggttggaaagaatttattcaagtactcatcagtaggggattagttaaataaattaaggaatagctacacaggggaacattatatagttgtaaaaacagcaaagaagttctatgtattgatatggaaagtctccaggaaaagttagaggaaaacaaggtatacaacaatgtgtaaacctactaagaagcagcatatttacacattgcttttatactctgtgtggctgtattttttcatacatatgaataatttatgtgtgaatatatgcagctatagtaataaagtttagaagactctattggaaattgattaccttggcaggtagagaatttaatgggttggaattgggcagattggagacagggatgggaataatttttctttatatgcctttttgatttgtgtatggttcaattgtaatacatatgaagaattatagtatataagacattttgagtgggaagtgaccaaaactgaattccaactggcttcagcaaacctctgttccatagtcaccaccaatgtaactgtcctcatcggtgttagagggttagtttctttattttttaggaattctgggaatattagatttatgtaagtgattattagtccacataggctaaccagaacagagttcctgtattttaagaggctttacaatttaatttattaatatcctttgaaaagtaggaaaatttattgcaccctatgataagcagataatgacttttatcagttccaggcacacagaacgctggtagtctcagatttatatcatcagccgtgggtaaaatgaatagagaacaccaaactgagcacttcggacatatctcaaagagctgttctctccagtggaattgaggcatatttgtacacagacagacaaaaattgactaacaaaccaaattctctgttgctaatagagagtagatatcaaatggtctgaccataaaatggacttccagccattgttgccaccagtggatagtaactggcgacaactgttgcagagccagaaccaaatttggcgaagaataagaaataaacaaaaaccgatcggaagaatagaaagagaaagatatcctgcttggaatttattccagggatgaagaaaagatattcctgggagtgaacagtccctgaggtgcagttcctgggtaatatgctatatttgtcttgagaaggaaatccgcttggacttctctgtggaacttcaacattgtcaagtgtaatttttcataagttatgagcaagaatctcatacaaataaagtgaatatgtgacagatatttacataatttcttagtgagggaaacagcaagatgataaggctggttcccataatctttcaatttgggggaagtagttttctctcctatttttcattttcattgaatgcattcaggtttaagtctgaagatgttttacagaaaactctggtaaaaaatacagcagtaggttacttaggtattatggttggcagcccttaactacagcttttttgttagatatgaaactacaatcaaacactttaagcataaaatttgtccataattttaaaagcatagaacaagagagtcaaataaatggatactaaatttcttattgagttggttcatcattgcatggcccataatgtatatataaatataatttttatacctcttaaactgtgtaacatttaccaataaacttttacactttgaggtataacacatataataaagtctacaaatcataaatgtacagcttgataaatttatacaaaatatatacccagataatcacaacccaatcaaggtatagattatttctagcacacacaaaacctttgtcccttctagtcagtacttctcccaaaggtaacttattctgactttgtcacaatagattaatttagcctgttcttgaacttaatgccaatagaattatatagcatgtactctaatgtctgacttctgttgcacaacatttatgagattcatctactttttgcaaattcctttttatttatgagtagtagtctattgtatgaaaaatattaaaactagtattgttgatttattttttctcttaataaataattgtatatagtggtatatgtaaatacacgatttttttaatatattgaccatgtaaaccagtgatcttgctaatgtattaattctaaattgcttatagagtcttttagattgtttatttacatgttatgtcttcaaataaagaaaaatgttttcttttccaatttttttttattattatactttaagttttagggtacatgtgcacaatgtgcaggttagttacatacgtatacacgtgccatgctggtgcactgcacccactaactcgtcatctagcattaggtatatctcccaatgctatccctcccccgtccccccaccccacaacagtccccagagtgtgatgttccccttcctatgtccatgtgttctcattgttcagttcccacctatgagtgagaatgtgcggtgtttggttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccattaatgggatggctgggtcaaatggtatttctagttctagatccctgaggaatggccacactgacttccacaatggttgaactagtttacagtcccagcaacagtgtaaaagttttcctatttgtccacatcctctccagcacctgttgtttcctgactttttaatgatcaccattctaactggtgtgagatggtatctcactgtggttttgatttgtatttctctgatggccagtgatgatgagcattttttcatatgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggctcttgttggcattgcttttggtgttttagacatgaagttcttgcccatgcctatgtcctgaatggtaatgcctaggttttcttctagggtttttatggttttaggtctaacgtttaagtctttaatccatcttgaattgatttttgtatcaggtgtaaggaagggatccagtttcagctttctacatatggctagccagttttcccagcaccatttactaaatagggaatcctttccccattgcttgttcttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgtctccggctttgttcttttggcttaggattgacttggcgttgtgggctcttttttggttccatatgaactttaaagtagttttttccaattctatgaagaaagtcattggtagcttgatggggatggcattgaatctataaattaccttgggcagtatggccattttcacgatattgattcttcctacccatgagcatggaatgttcttccatttgtttgtatcctcttttatttccttgagcaatggattgtagttctccttgaagaggtccttcacatcccttgtaagttggattcctaggtattttattctctttgaagcaattgtgaatgtgagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtgagtggtgagagagggcatccctgtcttgtgccagttttcgaagggaatgcttccagtttttgcccattcagtatgatattggctgtgggtttgtcatagatagctcttattattttgagatatgtcccatcaatacctaatttgttgagagtttttagcatgaagggctgttgaattttgtcaaaggccttttctgcatctattgagataatcatgtggtttttgtctttggttctgtttatatgctggattacatttattgatttgcttatattgaaccagccttgcatcccagggatgaagcccacttgatcatggtggataagctttttgatgtgctgctggattcagtttgccagtattttattaagggtttttgcatcaatgttcatcaaggatattggtctaaaattctcttttttggttgtgtctctgcccggctttggtatcaggatgatgctggcctcgtaaaatgagttagggaggattccctctttttttattgactggaatagtttcagaaggaatggtaccagtttctccttgtacctctggtagaattcggctgtgaatccatctggtcctggactctttttggttggtaagctattgattattgccacaatttcagctcctgttattggtctattcagagattcaacttcttcctggtttagtcttggtagagtgtatgtgtcaaggaatttatccatttcttctatattttctagtttatttgcgtagaggtgcttgtagtattctctgatggtagtttgtatttctgtgggatcggtggtgatatcccctttatcattttttattgcgtctatttgattcttctctctttttttctttattagtcttgctagcggtctatccattttgttgatcctttcaaaaaaccagctcctggattcattaattttttgaagggttttttgtgtctctatttccttcagttctgctctgattttagttatttcttgccttctgccagcttttgaatgtgtttgctcttgcttttccagttcttttaattgtgatgttagggtgtcgatgttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattccggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcagttttggaatgggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatgtaggatagttagctcttcttgttgaattgatccctttaccattatgtaatggccttctttgtctcttttgatctttgttggtttaaagtctgttttatcagagactaggattgcaacccctgcctttttttgttttccatttgcttgatagatcttcctccatccttttattttgatcctgtgtgtgtctctgcatgtgagatgggtttcctcaatacagcacactgatgggtcttgactctttatccaattttccagtctgtgtcttttaattggagcatttagcctgtttacatttaacgttaatattgttatgtgtgaatttgatcctgtcattatgatgttagctggttattttgctcgttagttgatgcagtttcttcctagtctcaatggtctttacattttgtcatgattttgcagcggctggtaccggttgttcctttccatgtttagcgcttccttcaggagctcttttagggcctgcctgtggtgacaaaatctctcagcatttgcttgtctgtaaagtattttatttctccttcacttatgaagcttagtttggctggatatgaaattctgggttgaaaattcttttctttaagaatgttgaatattggcgcccactctctaatggcttgtagagtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccgtcactttcaggtacaccaatcagacgtagatttgatgttttcacatagtcccatatttcttggaggctttgctcatttctttttattcttttttctctaaacttcccttctcgcttcatttcattcatttcatcttccattgctgataccctttcttccagttgatcgcattggctcccgagtcttctgcatttttcatgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctgagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtgctttctgtttgttagttttccttctaacagacaggatcctcagctgcaggtctgtgggagtacccggccatgtgaggtgtcagactgcccctgcttgggggtgcctcccagttaggctgctcgggggtcaggggtcagggacccacttgaggaggcagtctgcctgttctcagatctccagctgcgtgctgggagaagcattgctctcttcaaagctgtcagacagggacatttaagtctgcagaggttactgctgtctttttatttgtctgtgccctgcccccagaggtggagcctacagaggcaggcaggcctccttgagctgtggtgggctctacccagttcgagctttctggctgctttgtttacctaagcaagcctgggcaatggtgggcgcccctccccgagccttgctgccgcctagcagtttgatctcagactgctgtgctagcaatcagcgagactccgtgggcgtaggaccctccgagccatgtgcgggatataatgtcctggtgcgccattttttaggcccgtcggaaaagcgcagtatttgggtgggagtgaaccgattttccaggtgccgtctgtcacccctttctttgactaggaaagggaactccctgaccctctgcgcttcccgagtgaggcaatgcctcgccctgctttggcttgtgcacggtgcgcgcacccactgtcctgtgcccactgtctggcactccctagtgagatgaacctggtacctcagatggaaatgcagaaatcacccgtcttctgcgtcgctcacgctgggagctgtggaccggagctgttcctatttggccatcttggctcctctttctt

SEQ ID NO: 12511 - DNA, 6057 bp, Homo sapiens
tatttactccaatttttacttttctttttttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccacgtgatctcattgttcaattcccacctatgagtgagaatatgcggtgtttggttttttgttcttgcgatagtttaccgagaatgatggtttccagtttcatccatgtccctacaaaggacatgaactcataattttatatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttcagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttctcccagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggcattatttctgagggctctgttctgttccattgttctatatctctgttttggtaccagtaccatgctgttttggttactgtagccttgtagtatagtttgaagtcaggtagtgtgatgcctccagctttgttcttttggcttaggattgacttggcgatacgggctcttttttggttccatatgaacattaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtgtgttgttggtgtataagaatgcttgtgatttttgtacattgaatttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaacacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagatttaacttcttcctggtttagtctttggagggtgtatgtgtcgaggaatgtatccatttcttctagattttctagtttatttgtgtagaggtgtttgtagtattctctgatggtagtttgtatttctgtgggatcagtggtgatatcccctttatcattttttatcgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttgttttacatttgctgaggagagttttacttccaactatgtggtcaattttggaataggtgtggtgtggtggtgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcattcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgttttttaattggagaatttagtccattgacatttaaagttaatattgttatgtgtgaatttgatcctgtcattatgatgttagctggtgattttgctcgttagctgatgcagtttcttcctagcctcgatggtctttacattttggcatgattttgcagcagctggtaccagttgttcctttccatgtttagtgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcgtcggctcctgaggcttctgcattcttcacgtagttctcgagccttggttttcagctccatcagctcctttaagcacttctctgtattggttattctagttatacattcttctaaatttttttgaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggtgctctgcgttttagagtttccagtttatctgttctgttttttccccatctttgtggttttatctacttttggtctttgatgatggtgatgtacagatgggttttcggtgtggatgtcctttctgtttgttagttttccgtctaacagacaggaccctcagctgcaagtctgttggaataccctgcagtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtccagcttcccggctgctttgtttacctaagcaagcctgggcaatggcgggcacccctcccccagcctcgctgccgccttgcagtttgatctcagactgctgtgctagcaatcagcgagattccgtgggcgtaggaccctctgagccaggtgtgggatatagtctcgtggtgcgccgttttttaagccggtctgaaaagcgcaatattctggtgggagtgacccgattttccaggtgcgtccgtcacccctttctttgactcggaaagggaactccctgaccccttgcgcttcccaggtgaggcaatgcctcgccctgccccagctcgcgcacggtgcgcgcacccactggcctgcgcccactgtctggcactccctagtgagatgaacccagtacctcagatggaaatgcagaaatcacccatcttctgcatcgctcccgctgggagctgtagaccggagctgttcctattccgccatcttggctcctcccccaat

SEQ ID NO: 12512 - DNA, 5977 bp, Homo sapiens
atcttttattttattttattttattattattatactttaagttttagggtacatgtgcacaatgttcaggtttgttacatacatatacatgtgccatgttggtgtgctgcacccattaactcatcatttagcattaggtatatctcctaatgctatccctcccccctcccccccacctcatgacagtccccagagtgtgatgttccccttcctgtgtccatgtgttctcatggttcaattcccacctatgagtgagaacatgcggtgtttggttttttgtccttgcgatagtttgctgagaatgatggtttccagtttcatccgtgtccccacaaaggacatgaactcatccttttttatggctgcatagtattccatggtgtatatgtgccatattttcttaatccagtctatcgttgttggacatttgggttggttccaagtctttgctattgtgaatagtgctgcaataaacatacgtgtgcatgtgtctttatagcagcatgatttataatcctttgggtatatacccagtaatgggatggctgagtcaaatggtatttctagttctagatccctgaggaattgccacactgacttccacatggttgaactagtttacagtcccaccaacagtgtaaaagtgttcctatttctccacatcctctccagcacctgttgtttcctgactttttaatgatcgcaattctaattggtgtgagatggtatctcattgtggttttgatttgcatttctctgatggccagtgaagatgagcattttttcatgtgttttttggctgcataaatgtcttcttttgaggagtgtctattcatatccttcgcccactttttgatggggttgtttgtttttttcttgtaaatttgtttgagttcattgtagattctggatattagccctttgtcagatgagtaggttgggaaaattttctcccattttgtaggttgcctgttcacctgatagaagtttcttttactgtgcagaagctctttagtttaattagatcccatttgtcaattttggcttttgttgccattgcttttggtgttttagacatgaagtccttgcctatgcctatgtcctgaatggtattgcctaggttttcttctagggtttttatggttttaggtctaacatgtaagtctttaatccattttgaattaatttttgtgtaaggtgtaaggaagggatcaagtttcagctttctacacatggctagccagttttcccagcaccatttattaaatagggaatcctttccccatttcttgtttttgtcaggtttgtcaaagaccagatggttgtagatatgcatcattttttgagggctctgttctgttccattgatctatatctctgttttggtaccagtaccatgctgttttggttactgtagccttgtagtatagtttgaagtcaggtagcgtgatgcctctggctttgttcttttggtttaggattgacttggtgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttcttgttgaagaggtctttcacatcctttgtaagttggattgctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggcgagagagggcatgcctgtcttgtgccagttttaaaagggaatgcttccagtttttgcccattcagtatgatattggctgtgggtttatcatagatagctcttattattttgagatacgtcccatcaatacctaatttattgagagtttttagcatgaagggttgttgaattttgtcaaaggccttttctgcatctattgagataatcatgtggtttttatctttggttctgtttatatgctggattacatttattgatttgcgtatattgaaccagccttgcatcccagggatgaagcccacttgatcatggtggataagctttttgatgtgctgctggatttggtttgccagtgttttattgaggatttttgcatcaatgttcatcaaggatattggtctaaaattctcttttttggttgtgtctctacctggctttggtatcaggatgatgctggcctcagaaaattagttagggaggattccctcgttttctgttgattggaatagtttcagaaggaatggtaccagctcctccttgtacctctggtagaatttggctgtgaatccgtctggtcctggacttttttttggttggtaagctattgattattgccacaatttcagagcctgttattcatctattcagagattcaacttcttcctggtttagtcttgggagggtgtatgtgttgaggaatttatccatttcttctagattttctagtttatttgcatagaggtgtttgtagtattctctgatggtagtttgtatttctgtgggatcggtggtgatatcttctttatcattttttattgcgtctatttgattcttctctcttttcttctttattaatcttgctagcggtctatcaattttgttgatcttttcaaaaaagcagctcctggattcattaattttttgaagggttttttgtgtctctatttccttcagttctgctctaattttagttatttcttgccttctgctagcttttgaatatgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcagttttgagtgagtttcttagtcctcagttctagtttgattgcactgtggtctgagagacagtttgttataatttctgttcttttacatttgctgaggagagctttacttccaagtatgtggtcaattttggaatagatgtggtgtagtgctgaaaaaaatgtatattctgttgatttggggtagagagttctgtagatgtctaccaggtctgcttggtggcagagctgaggtcatttcttgggtatctttgctaactttctgtctcattgatcggtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacatgacatgggtttcctgaatacagcacactgatgggtcttaactctttatccaatttgccagtctgtatcttttaaattggagcatttagtccatttacatttaaagttaacattgttatgtgtgtatttggtcctgtcattatgatgttagctggttattttgcttgttagttgatccagtttcttcctagccttgatggtctttacattttggcatgttttttcagtggttggtaccagtttttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttggaaattcttttctataagaatgttgaatattggcccccactcccttctggcttgtagagtttctgctgagagatccactgttagtctgatgggcttccctttgagggtaacccgacctttctctctggctgcccttaacattttttccttcatttcaactttggtgaatctgacaattatgtgtcttggagttgctcttcttgaggagtatctttgtggctttctctgtatttcctgagtctgaatgttggcctgccttgctggactggggaagttctcctggataatatcctgcagagtgttttccaacttggttccattctctctgtcactttcaggtacaccaatcagacgtaggtttagtcttttcacatagtcccatatttcttggaggctttgtttgtttctttttattcttttttctctaaacttcccttcttgcttcatttcattcatttcgtcttccatcactgatatcctttcttccagttgattgcattggctcctgaggcttctgcattcttcacatagttcttgagccttggctttcagctccatcagctcctttaaggacttctctgcattggttattctagttatccattcatctaattttttttcacagtttttaacttctttgccattggtttgagtttcctcctgtagctcggagtagtttgatcatctgaagccttcttctctcaactcgtcaaagtcattctccgtccaggtttgttcagttgctggtgaggaactgtgttcctttggaggaggagaggcactctgctttttagagtttccagtttttctgctctgttttttccccatctttgtggttttacctacttttggtctttgatgatggtgacgtacagaagggtttttgatgtggatgtcctttctgtttgttagttttccttctaacagacaggaccctcagctgcaggtctgttggagtttgctaggggtccactccagaccctgtttgcctgggtatcagcagcggtggctgcagaacagcagtggctgtagaacagcggatcttggtgaaccgcaaatgctgctgcctgattgttcctctggaagttttgtctcagaggagtacccagccgtgtgaggtgtcagtctgccactactggggggtgcctcccagttaggctgctcaggggtcaaggacccacttgaggaggctgtctgcccgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcaggcgcccctcccccagccttgctgccaccttgcagtttgatctcagactgttgctgtgctagcaatcagcgagactccgtgggcgttggaccctctgagccatgtgcgggatataatctcctggtgtgccatcttttaagcccattggaaaagtgcagtattagggtgggagtgaccggattttccaggtgccatctgtcaccccattctttgactaggaaagggaactccccgacc

SEQ ID NO: 12513 - DNA, 5035 bp, Homo sapiens
ttttgtttttttctttcatttttattatttactagtttcttttttttctgtttttattatactttaagttttagggtacatgtgcacaacgtgcaggtttgttacatatataaacatgtgccatgttggtttgctgcacccattaacttgatatttaacattaggtatatctcctaatgctatccttcccccctgcccccaacccatgacaggccccggtgtgtgatgttccccttcctgtgtccatgtgttctcattgttcaattcccacctatgagtgagaacatgtggtgtttggttttttgtccttgcgatagtttgctgagagtgatggtttccagcttcatccatgtccctgcaaaggacatgaactcatcattttttatggctgcatagtattccatggtgtatatgtgccacattttcttaaaccagtctatcattgttggacatttgggttggttccaagtctttgctattgtgaatagtgccacaataaatatacgtgtgcacgtgtctttatagcagcatgatttataatcctttgggtatatacccagtaatgggatggctgggtcaaatggtatttctagttctagatccttgaggaatcgccacactgacttccacaatggttggactagtttacagtcccaccaacagtgtaaaagtgtttctatttctccacatcctctccagcacctattgtttcctgactttttaatgatcgccattctaaatggtgtgagatggtatctcattgtggttttgatttgcatttctctgatggccagtgatgatgagcattctttcatgtgtctgttggctgcataaatgtcttcttttgagaagtgtctgttcatatcctttgcccacttgttgatgaggttgtttgtttttttcttgtaaatttgtttgagttcatcgtagattctggatattagccctttgtcagatgagtagattgcaaaaattttctcccattctgtaggttgcctgttcactctgatggtagtttcttttgctgtgcagaagctctttagtttaactagatcccatttgtcaattttgtcttttgttgccattgcttttggtgttttagacatgaagtccttgcccatgcctatgtcctgaatggtattgcctaggtttccttctagggtttttatggttttagttctaacatttaagtctttaatccatcttgaattaatttttgtataaggtgtaaggaagggatccagtttcagttttcgacataaggctagccagttttcccagcaccatttattaaatagggaatcctttccccatttcttgtttttgtcaggtttgtcaaagatcagagagttgtagatatgtggcattatttctgagggctccgttctgttccattggtctatatctctgttttggtaccagtaccatgctgttctggttactgtagccttgtagtatagtttgaagtcaggtaacatgatgcctccagctttgttcttttgacttaggattgacttggcaatgctggctctttggtggttccatatgaactttaaagtagtttttttccaattctgtgaagaaagtcattggtaacttgatggggatggcattgaatctataaattaccttgggcagtatggccattttcatgatattgattcttcctacccatgaacatggaatgttcttccatttgtttgtgtcctcttttatttcattgagcagtggtttgtagtgctccctgaagaggtccttcacatcccttgtaagttggatacctaggtattttattctctttgaagcagttgtgaatgggagttcactcatgatttgactctccatttgtctgttattgatgcataagaatgcttgtaatttttgcacattgatttcatatccagaaactttgctgaagttacttatcagcttaaggagattttgggctgagacaatggggttttctagatatacaatcttgtcatctgcaaacagggacaatttgacttcctcttttcctaatggaataccctttatttctttctcctgcctgactgccctggccagaacttccaacactatgttgaataggagtggtgagggggcatccctgtcttgtggcagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatctattgagataatcatgtggtttttgtcattggttctgtttatatgctggattacatttattgattttcatatgttgaaccagccttgcaatgcaggaatgaagtcctcttgatcatggtggataagcttcttgatgtgctgctggattcggtttgccggtattttattgaggatttttgcatcgacgttcattgggatattggtctaaaattctctttttttgttgtgtctctgccaggctttggtatcaggatgatgctggcctcatgaaatgagttagggaggttttcctctttttctattgattggaatagtttcagaaggaatggtaccagctcttccttatacctctggtagaatttggctgtgaatccgtctggtcctggacttttttttggttggtaagctattaattattgcctcaatttcagagcctgtcattggtctattcagatattcaacttcttcctggtttagtcttcggagagtgtatgtgttgaggaatttatccatttcttccagattttcttgtttatttgcatagaggtgtttgtagtattctctgatggtagtttgtatttctgtgggatcggtggtgatatcccctttatcattttttattgcggctatttgattcttctctctttttttctttattagtcttgcaagcagtctgtcaattttgttgatcttttcaaaaaaccagctcctggattcattgattttttaagggttttttgtgtctctatttccttcagttctgctgtgatcttagttatttcttgccttctgctaacttttgaatgtgtttgctcttgcttctctggttcttttaattgtgatgttagtgtgtcaattttagatctttcctgctttctcttgtgggcatttagtactataagtttccctctacacactgctttgaatgtgtcccagagattctggtatgttgtgtctttgttctcactagtttcaaagaacttctttatttctgccttcatttcattatgtacccagtagtcattcaggagcaggttgttcagtttccatgtagttgagcagttttgagtgagtttcttaatcccgagttctagtttgattgcactctggtctgagagacagtttgttataatttctgttcttgaacatttgctgaggagtgctttacttccaactatgtggtcaattttggaacaggtgtggtgtggtgctgaaaagaatatatattctgttgatttggggtgaagagttctgtagatgtctattaaggctgcttggtgcagagctgagttctattcctggatatccttgttaactttctgtctcactgatgtgtctaatgttgacagtgggttgttaaagtctcccattattattgtgtgggagtctaactctctttgtaggtctctaaggacttgctttatgaatctgggtgctcctgtattgggtgcatatatatttaggaaagttagctcctcttgttgaattgatccctttaccattaagtaatggccttctttgtctcttttgatctttgttggtttaaagtctgttttatcagagactaggattgcaatccctgcctttttttgttttccatttgcttggtagatcttccttcatccctttattttgagcctacgtgtgtctgtgcacatgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctgattattttgcttgttaattgttgcaatttcatcctagcatcaatgatctttataatttggcatgtttttgcagtggctggtagaagtttttcctttccatgtttagtgcctccttcaagagctcttttagggcaggcctggtagtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatcagctgttagtctgatgggcttccctttgtgggtaacctgacctttctctctggctgcccttaacattttttccttcatttcaactttggtgaatctgacaattatgtgtcttggagttgctgttctcagtgagtatctttgtggcattgtctgtatttcctgaatttgaatgttggcctgcctttctagattggggaagttctcctggataatatcctgcagagtgttttccaacttggttccattctccctgtcactttcaggtacaccaatcagacgtagctttggtcttttcacagtcccatatttcttggaggctttgttcatttctttttattcttttttctctaaacttctcttcttgcttcatttcattcatttgatcttccatcactgataccctttcttccagttgattgaatcggctaatgaggcttgtgcatttgtcatgtagttcttgtgcctcggttttcagctctgtcaggtagttaaaggacttctctgtattggttattctagttagccattcatttaatctttttccaaggtttttaacttctttgccatgggttcaaacttcctcctttagcatgaagtagtttgattgtctgaagccttcttc

SEQ ID NO: 12514 - DNA, 12043 bp, Homo sapiens
gaaaaaaagttttttttttcttattatactttaagttttagggtacatgtgcacattgtgcaggttagttacatatgtatacatgtgccatgctggtgtgctgcacccactaactcatcatctagcattaggtatatctcccgatgctatccctccccgctccccacaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcgttttttatggctgcatagtattccatggtgtatatgtgccacattttcttaatccagtctatcattgttggacatttgggtggttccaagtctttgctattgtgaatagtgccccaagaaacatacgtgtgcatgtgtctttatagcagcatgattgatagtcctttgggtatatacccagtaatgggatggctgggtcaaatggtatttctagttctagatccctgaggaatcgccacactgacttccacaatggttgaactagtttacagtcccagaaaaaaagttttttgataaaagatttggttaagccctgggagcagatctggatccaattccaactctgtttatttactaacttaaaacaaccaagcctcagttcccagaagagaaaaaattattgtacctatatttgtagggctgctgtgaacagtaaatgagttaatatttgtacatctggaataacattttggtgtattagctgatatatttccagggagaatttagcacaatgtcaaactacaaatgtaaattcttattcttggagtacctaatagatgtgaatgaatatctactgaatcagatctttatgtcacagaggctgaagcataccctgggataggagaaaagatgggcaaggtggaaaggagagtactgatgttaatgagacagaaaacctgagaaaatgtaggaaggagggcacacccttccttgaccttcatagagaaatatagttccctcctatatgcttggtaatctcagattatagagaacagcaacatgttgtaagagtagcagagtagaagcactgaatgttatgttagaggattttgaggctgacaagttcccacccatgcatggtacaggagcagctgactgtttcccagtgtaatcagcactggagcagaggggacactgagagttctagatctggagggctattgcggtgcaggtggagaatgcaacagtaggtgccagggaatcaagtaagaccaaaaaatgctagtgaaaaataaccgtctcaatcaaatgagacaatgaagaccccaggagaggttaacctagatagaacacagctgaggacaaaatactttctttgcccaaaaactggatactgcataaatatctccagctgccctccagtgcctaccacaataccaagaaaactgaagggagagtggaagaaaccctgaatggacttagttcatccagagattaggattccatctttgccaccagtggaatcaattttgaaataaaagttcagtcatagaaaaaaaatggttacatttctagttcactaaatttatagtcagtaaaacttggactttctatacttacaaagggctaagccctgtgactggcacagaaaattagatctataaaagatagcttgtattactatcaagaaggagaatttgtgaggtggaaagaattggaggtttaagaaaattgaaaagcttgtgcttggtaacaagaagggtctcaatcaatatttgttaaaaaaaatcatagattaaagctggaggcaaggtggttggatcataaccttattgtggcaggagcacaccttaatcttctttcgttcctcataacacctagcacagttttggatccattgttttttgcttcctacatatttgttaaaataatgaaaattgaagaacactattggtgatattggagtaggagaatagggaaatacatggactagagccttcagagggagacttatatttatgaaggtcaagtcagcgaacaagacttcagaagtcatgatttaaagaaaggtggagggtgagcatgttcatattaagcagatatttgtagtaaattgagaggaatggagatatcaaatatggtagaagaaaacccttgaaaaagataaatttgcatttgaagagataatctatatcataataccataatatttctccagaaaaatgagaggtttttccagctataccaaatatgtgtcagaggttttcaatatttttgaaattttatttccaattgacagataataattgtatatattggatatttatagggtacaatgtaatattttggtatgtttacatcactgaatgattaaatcaagctgaaatcaatcctctctgagattgtatagcgtgagtacttaggtgccaggcagtgaatgagggttttcagttatcctagtatgttctgttacattggaattcttttgttgttgttgcttaactttttgtgtcatgattcctaaaatatttgaattagtaattactcctagttcagaagtcacaaaatataataataaatatagtgaaaagtcttccacccgctccctatcctctgtgtcttcagtttcaagcaatctctcaacacataggtaataattattaggttcttgatactttggatgcatctatggcaattataactatattgtcttaaccccactccttttttcccaagacagcttcatatacacactgtttaatatctttatttctttctttaatttaacaatatattttgaagatattataaataaaatttgggggggtgtcataatttacctactccactaatgctggacatttgtgtgaatttctatctttacaattattaatgcagaagtaagtaacacgtgtgtcattttcacacatgctagtatttatagcataagttctcagttttcttacccaggaattatcgggcaaagagttatacacttattttgataatgcagtctttccttggtattcatggtttcaggacccctacagataccaaaatctgtggggatgctcaagtctcttatataaaatggtgtggtatgtatttgcatataatgtactcacattctccgtttatatactttaaatcctctctagactacttataatatcgaatacaatgtaaatgctatgtaaatagttgttatactgtatttctttttaaatttgtatcatttttattgttatgttatttcttccaagtattttcaattggtagttggttgaatccacagacgcagaacccacagatgctgaggactgactgtatccccaaagtacccttcataagatttgtttctttggattcattttaaatctcatcacctagagtagattttctttgagaaaatcctcaatgacatctgtgttaggccatccttgcactgctataataaaatagttgagactgcatgatttaaaaagaaaagtttaattggcccacagttctacagtctttacagaaagcaggctgttggtatctgctcctggggaggccccaggaagcttacaatcatggcggaaagtgaagcaggagcaggcacatcacatggtgaaagcaggagcaagagagagagagtaacagggaggtgctcacatttttaaacaaccgggtctcttgagaactcactcaccatcacaagaacagtatcaagcaatgaggcatcctcctccatgacccaaacacctcccaccagccccacctccaacattggggattacatttcaacatgagatttggagagggtatggattcaaactataacaacatctaaatgtgacaagactagaaagtccaaataagggagtcatttattaaaatttttctaagactttaaatgttaaaaataatgaaaggttaccactgatctttataattaagcatcacgactgaaccaaattactcagaaagataatcacagagtcagttggtttatgttgtaactccacagagggcctgaaagtcgatttaatcttagggattggtaaagggcttgcatttatttgacaggatactttcagtttactaggcactgtagagttatccgtctctaagactcagacatattatgcttctcacgctttctaaaatggttcaaccaaaatgtcactgaagaaagaagttggcatcaaagttaataattaaaaatcctaatattcacctgcagtggagagaaaccctaaggatcatcatatgtggatatttgaagatactttagtagactacaattttaacttaaaggtttaaacttatgcaaaaatattcatgtgtttttgttttgttttgctgtttatttgtttgtttttgtgacagagttttgctcttgttgcccagactggagtgcaatggtgcgatcttggctcaccacaacctccgcctcctggattcaagtaattctcctgcctcagcctcccgagtagctgggattacaagcatatgccaccacatccggctgattttgtatttttaatagagatggggtttctccatgttggtcaggctggtcttgaactccacccaaaggtgatctgcccacctcagcctcccaaagtgttgggattacaggcgtgacccacagtgcccagccatttcatgtgtttttgtatatatatttatacatcaaataatttatctgtagggcttagcagtcacacaataatccttagaatatcagctctaatgggctaattggggagtgctttaacatgtgtagaaatctttgttcaaagtacaggatgccaagaggggcttggtgcagctgtagaatcctgaagcaagaaaagaggtatagactgaagaaaagaacaaggtcataccatggaggtagagaagataaaactcttattgggcatctgtctgggcactgacactccaacaaaaacagatgcatggataaataaataatggttatgatttttttaaatcaatagttattatagaatattgaagatattccactgtatctagttttcattgttgctgatgggatatcaattagttatggtctttattcagaagtcacttattttcttctaactctatttttaaatttcatttttaattgataacatgatatttgtacctacttatagggtacacgtgaattttgtcacattcatagattgtataatgatctagtcatcacttcaaatacttatcatttctatgtgttgggtacacttcaacactttaagtcctcttttctagctattttgaaatataaatacattacaatacattattgttaactgtagtcaccctacttacagtaggacattagaacttatttcttctatctctatctaactgtgtgtgtggttttttttttttttttttttgagacggagtctcgctctgtcacccaggctggagtgcagtggttccatctcggctcgctgcatgctccgcctcctgggctcatgccattctcctgcctcagcctctggagtagctgggactacaggcgcccgccaccatgcccggagaattttttgtatttttagtggagacggggtttcaccgtgttagccaggatggtctcgatctcctgacctcgtgatccacccgcctcggcctcccaaagtgctgggattacaggcgtgagccaccgcgcccagcctaactgtgtgttaatacccattaagcaacctctcttcatctcccttaccacaccagacaatacaaaaactattccaagcctctagtatctatcattctactctctacctccttgagattaactttgttagctcccacatatgagtgagaacatttgctgtctccctttctgtgcctggcttatttcacttaaaataatgacctccaaaggccaggcgcggtggctcatacctgtaatcccagcactttgggaggccgaggcaggcggatcacgaggttaggagatcaagaccatcctggctaacatggtgaaaccccatctctactaaagtacaaaacaattagccgggtgtcgtggcgggcgcctgcagtcccggctacacaggaggctgaagcaggagaatggcgtgaacccgggaggcagagcttgcagtgagctgagatcatgccactgcactccagcctgggcaacagagcgagactccatctcaaaaaaaaaaataatgataataataataataataatgacctccagttccatccctgttgctgcaaatacatgatttcattttcttttatagccaagtagtattccattgtgtgtatacatcacatttgtctttatccatttttccattgatggacacaggttgattccctaataaacatgaggacgcagatattctttgatatgctgattttcttttctttggataaatatctaatagtggattgctggtttgttttgtagttctatttttagtttttttttttttttgagaaatttccatactgttctccacagtggctctagtaatttacattcccagcaacaatgtataagagttcctgtttctctcatcctcaccagcatctgctactttttgtctttttaaaaatagccattctaaatggggtaagaggatctcttattatggttttgatttgcgtttcctcatgattagtgatattgagcatttttttgtgcacctgttagctatggttatgtgtgcttttgagaaatgtctattcatgtccttggcccatttgctaaatggcattatttgggtcttccctgttgggttccttgtattttttttttttttttttttggtctattcagggattcaatttctttttctttttcttttttttaattatactttaagtcctagggtacatatgcacaacgtgcaggtttgttacatatgtatacatgtgccatgttggttgctgcacccattaactcgtcatttacattaggtatatctcctaatgctgtgtcatgtgccccaaccccatgacaggccctggtgtgtgatgttccccgtcctgtgtccaagtgttctcatcgttcaattcccacctatgagtgagaacatgtggtgtttgattttttgtccttgtgatagtttgctgagaatgatggtttccagcttcatccatgtccctacaaaggacatgaactcatccttttttatggctgcatagtattccatggtgtatatgtgccacattttcttaatccagtctatcatagatggacatttgggttggttacaagtctttgctattgtgaatggtgccacaatgaacatacatgtgcatatgtctttatagcagcatgatttataatcctttgggtatataccaagaaatgggatggctgggtcaaatggtatttctagttctagatccctgaggaatcgccacactgacttccacaatggttgaactagtttacagtcccaccaacagtgtaaaagtgttcttacttctccacatcctctccagcacctgttgtttcctgactttttaatgatcaccattctaactggtgtgagatggtatctcattgtggttttgatttgcatttctctgatggccagtgatgatgagcattttttcatgtgcctgtcggctgcataaatatcttcttttgagaagtgtctgttcatatccttcacctgctttttaatgggtttttttttttttttttttttgtaaatttgtttgagttctttgtagattctggatattagccctttgtcaaatgagtagattgcaaaaatattctcccattctgtaggttgcctgttcactctgatggtagtttcctttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggcgtaaggaagggatccagtttcagctttctacacatggctatccagttttcccagtaccatttattaaatagggaattctttccccattgcttgtttttctcaggtttgtcaaagatcagacggttgtagatgtgtggcattatttctgagggctctgttctgttccattggtctatatctctgttttggtaccagtaccatggtgttatggttactgttgccttgtagtatagtttgaagtcaggtagtgtgatgcctccagctttgttcttttggcttaggattgtcttggcaatgagggctcttttttggttccatatgaactttaaagtagtttttttccaattctgtgaagaaagtcattggtagcttgatcgggatggcattgaatctagaaattaccttgggcaatgtggccattttcacgatattgattcttcctatccatgagcatggaatattcttccatttgtttgtatcctcttttatttccttgagcagtggtttgtagttctccttgaagaggtccttcacatcccttgtaagttgtattcctaggtattttattctctttgaagcaattatgaataggagttcactcatgatttggctctctgtttgtctgttattgatgtataagaatgcttgtgatttttgcacattgattttgtattctgagattttgctgaagttgcttataagcgtaaggatattttgagctgagatgatggggttttctaaatatacaatcatgtcatctgcaaacagggaaaatttgacttcctcttttcctaattgaataccatttatttctttctcctgcctgattggccctggccagaacttccaacactatgttgaataggagtggtgagagagggcatccctgtcttgtgccagttttcaaagggaatgcttccagtttttgcccattcggtatgatattggctgtgtgtttgccataaatagctcttattattttgagatacgtcccatcaataccaaatttattgagggtttttagcattaaaggctgttgaattttgtcaaaggccttttctgcatctgttgagataatcatgtggtttttgtctttggttgtgtttatatgctggattacgtttattgatttgcatatgtttaaccagccttgcatcctatggatgaagcccacttgatcatggtggatgagctttttgatgtgctgctggaatcggtttgccagtattttattgaggatttttgcattgatgttcatcaggggtattggtctaaaattatcttttttttgttgtgtctctgccaggctttggtaacaggatgatgctggcctcataaaatgagttagggaggattctctcttttgctgttgattggaatagtttcagaaggaatggtaccagctcctccttgtaccactggtagaattcggatgtgaatccgtctggtcctggagtttttttggttgataggctattaattattgcctcaatttcagagcctgttattggtctattcagggattcaagttcttcctgatttagtcttgggaggttgtatgtgtccaggaatttatccatttcttctagattttcaggttatttgcgtagaggtgtttatagtattctctgatggtattttgtatttctgtgggatcagtagtgatatcccctttatcattttttattgtgtctatttgattattctctcttttcgtctttattagtcttgctagtagtctatcaattttgttgatcttttcaaaaaaaacagctcctcgattcattgatttttttgaaggattttttgtgtctctgtctccttcagttctgctctgatcttagttatttcttgccttctgctaacttttgaatgtgtttgctcttgcttctctagttcttttaattatgatgttagggtgtcaattttagatctttcctgctttctcttgtgggcatttagtgctataaatttccctctacacactgctttaaatgtgtcccagagattctggtatgttgtgtctttgctctcattgggttcaaagaacatctttatttctgccttcattttgttatgtacccagtagtcattcaggagcaggttgttcagtttccacgtagttgagcggttttgagtgagtttcttaatcctgagttctagtttgattgcactgtggtctgagagacagtttgttataatttctgttattttacacttgctgaggagtgctttacttccaactatgtggtcaattttggaataagtgtaatgtggtgctgagaagaatggatattctattgatttggggtggagtgttctgtagatgtctgttaggtctgcttggtgcagagctgagttcaattcccggatatgcttgttaactttctgtctcgttgatctgtctaatgttgacagtggggtgttaaagtctcccattattgtgtgggagtgtaagtctctttgtaagtctctaaggacttgctttatgaatctgggtgctcctgtattgggtgcatatatatttaggatagttagctcttcttgtttgaattgatccctttaccattatgtaatggccttctttgtctctcttgatctttgttggtttaaagtctgttttatcagagtctgggattgcaaaccctgcctttttttgttttccatttgcttggtagatcttcctccatccctttattttgagcctatgtgtgtctctgcacttgagatgggtctcctcaatacagcacactgatgggtcttgactctttatccaatttgccagtctgtgtcttttaattggagcatttgacccatttacatttaaggttaatattgttatgtgtgaatttgatcctgtcattatgatgttagctggttattttgctcgttagttgatgcagtttcttcctagcatcgatggtctttacaatttggcatgtttttgcagtggctggtactggtttttcctttccatgtttagtgcttccttcaggaggtcttgcagggcaggcctgatggtgacaaagtctctcagcgtttgcttgtctgtaaaatattttatttctccttcacttatgaagcttagtttggctggatatgaaattctgggttgaaaattctttcctttaagaatgttgaataatggccctcactctcttctggcttgtagagtttctgctgagagatccactgttagtctgatgggcttccctttgtgggtaacccaacctttctctctggcttcccttaacactttttccttcatttcagctttggtgaatctgacaattatgtgtcttggagttactcaaggagtatctttgtggctttctctgtatttcctgaattggaatgttggcctgtcttgctaggttggggaagttctcctggataatatcctgcagactgttttccaacttggttccattctccccatcactttcgggtacaccaatcagacgtagatttggtcttttcatatagtcccatatttcttgcaggctttgttcatttctttttactcttttttctctaaacttctcttctcacttcatttcattcatttgatcttcaatcactgatacccttacttccagttgatcaaatcagctactgaagcttgtgcattcatcacgtagttctcatgccatggttttcagctccatcaggtcatttaaggatttgtgtacactggttattctagttagccattcgtctaatcttttttcaaggtttttagcttctttgcgatgggttctaagttcctcctttagcttggagaagtttgatcgtctgaagccttcttctctcaactcatcaaagtcattctctgtccagctttgttctgttgctggtgaggagctgtgttcctttggagggggagaggcactctgatttttagaattttcagcttttctgctctgtttttcccccatctttgaggttttatttacctttggtctttgatgat

SEQ ID NO: 12515 - DNA, 45698 bp, Homo sapiens
ttttcattttttttgagacagagtcttgctctgtcacccaggctggagtgcagtggctcgatcttggctcactgcaagctccgcctcctgggttcacgccattctcctgtctcagccacccgagtagctgggactccaggcacccgccaccacacccagctaattttttgtatttttagtagagacgcggtttcaccatgttagccaggatggtcttgatctcctgacctcgtgatcctcctgcctcggcctcccaaagtgctgggatttcaggcgtgagccaccgtgcccggcctgtattttttaaattattattttgttgttgttgttgttgttgttgttgagacagggtctcactctgttgcccaggctggagtgcagtggtgtgattatggctcactgtagccttgacctcccaagcccgagcgatcctctgagtagctgggactacaggcgcatgacaccatgcctggctaatttttgtattttttgtagagacagggttttgtcatgttgcccaggctgatctcaaactcatgggctcaagtgatctgtccccctcagcctctcaaagtgctgggatttcaggcatgaaccaccatgcctggctcctcaccaaatttttttttttaatttttttttaaattttattttatagagatggggtttcaccatgttgtccaggctagtctcgaactcctgggctcaagtgatctgcccaccttcgcctcccaaagtgctgggattacaggcttgagccactgtgcccagccatcaccaccaaatttttaagacaaaaaaattttattttccatagaaaataaatccttttcttaggggatgctgccccattgagaataattttaaaaacgattttgattttcagatgaaatcaggacttcccagattgtgttttgtgatgaactagtttttgacatgttaacagaatacccatggggggcagggaatagtctaaggttgaattaaaatagttttctttttctcctaattgcatgatttttcatggcctttaatgtgtcaatgaatatttttcaatttactagaggaagatgcattatttccccaaacaatttcattgtggattcctttggaaattgctgaactcacttgtttaaaatataacccctgtaggcatattagattctgtgggttgcactttgaagataaagacaagaatgtctgtaatgtgttccatttacagtaggatctaggcagcctttggtcacctagagaactttgagttgcatatgtcttgctattatttgtaagcatgtctgttctaccagaaggttatggaataattcaaccctgagctgtgaaatttaataaacctaggaaaagttatgaaaaaaattatggaaaactaatatgcaaaactatattgtatatcaacctaaaagtggcaggaagatggagtggccaaaataagtaaaccctaggtttcctatgttgataatactggtaaaatttttcttctgttaatagttcaaataattttcataacgggattatatgcaaattagaggagacagcgcattcaatgaaaaatatatgaatgcatctctaaaaatgtactaaaatggacatataaataaattagattctttggagaaatctgaaggaaaattgatgatcagatagaaatatcagtgaaacacacaaaagaacacaaagaaaacaaatcaatgaaataggtggaaaccattacattttaaaaattttagtttcagggggtacatgtgcaggtttattttgtggatatattgagtgatgctgaggtttgggcttctaatgatcccattgcccaagtattgagcatactacctgataggcagtttttcagcccttgttcctttccctccctccctccccacttttggagtccacaatgtctgttgttcctatctttgtgtccatgtgtacccagtgtttagctcccacttacaagtaagaacctgccttacttggctttttttctgtgttagtcctcttaacataatggcctccagctgcatccatgttgctgcaaaggacatgatttcattcttgttgatgactgcatagcattccatggtgtatatgtaccacattttctttatccaatccaccattgataggcacttgggttgattccatgtctttgctattttgaatagtgttgtgataaacatgtgagtgcaggtatctttttggtagaatgatctattttcctttgggtatatacccagtaatggaattgttgggttgaatggtaattctatttttagttctttgagaaatctccaaactgttttccacaggggctgaactattaataatttgcattcctgccacaggaatttcttctcaacctcaccaatatctggtatttttcatttatttatttattttgagacggagtctcactctgtcgcccagactggagtgcggtggcgtgatatcagttcactgcaacctctgcctcctgggttcaagtgattcttttgcctcagcctcctgaatagctgggactacaggcatctgccaccatacctggctaatttctgtatttttagtagagacggggtttcaccatattggccaggcttgtctcgaactcctgacctcatgatccacccacctcggcctcccaaagtgctaggattacaggcgtgagccaccgtacctggcctatctgttactttaaaatttttttcataatagccattctgactggtggtatctcattgtggttatgatttgcatctctctgatgattagtgatgttgaacattttttatatgtttgttggctgctgtatgtcttcttttgagaagtgtctatatcctttgcccattttttaatgggatttttgtttttctcttattgatttaagttccttatagactctggatattagtctgttgttggatccatagtttgcaaatattttctcccattctgtaggttgtctgtttactctgttcatagtttcttttgctgtgcagaagcgctttagtttaattaagtcctgtttgtttattttttattttgtggcatttgctttggggatcttcatcatacattttttgcctaggccactgtttagaagagtatttcttggttgtcttctaggattttttatagtttcaggtcttacatttaagtctttaattcatcttgagttaatgtttatacatggtaagaagcaggagtccaatatttctttcttctgcgtgtggttagccagttttcctagcactatttcttgaagaaggtattttttcctcattgtttatttttgtcaactttgttgaagatcagttggtttaggtgtgtgactttctttcaggggtctctattctgtttcattggtctatgtgtatatttttataccagtactatgctgtttaggttactgtagccttgtagtattgtttgaagtcaggtaatgtgatacctttggctttattctttttgcttaagattaccttggctatttggtctaattttttggttccatatgaattttaagtagtttttctaattctaggaaaaatgttactggtaattagataggaaagcattgaatctgtatattaatttgagcagtacggacatttgaatcatattgatttttccaactcatgagcatggaatgcttttctatttgttaatgttgtctctgatttctttcatcagtgctttgtagtcttccttacagagttgcttcacctccttggctagatgtattccaaggtactttttttcctgtggctattataaatgggattgtgttcttgatttggttctcagcttgaatgttattggaggagttcttcctccttgaatttttgtaatagtttcagtagggtcagtaccagctcttctttgtatgtctagtagaattcagctgtgaatccatctggtccagggctttgtttgattggtatgtttttagaaaaattactgatccagttccatgacttgttattggtctgttcagaatttttgtttcttcctgattcaatcttggaaggttgtgtgtttccaggaatgtatcagtttcctctagatttgctagtttgtgtgcatagagatgttaatagtactctctgagggtcttctgtatttctatgagcttggtagtaataactcctttgtcattctaactgtaattatttggatacgccctctttttttctttgttaatctggctagtgatctgtctagtttattgtttcaaataaccaatttttcatttcattgatcgtttgcatgttttttttgggtctccatttagttctgctctgattttagttatttcttttcttctgctaactctgggtttagtttgtctttgttttttttagttcctttaggtgtgaggttaggttgttaatttgagatctttctatctttttgacataagcattcagtgctataaacttttctcttaacactgcttttgccacatcacagaggttttggtacattgtgtctctattttcatttgtttcaaagcattttttcatatctgccataattttgttgttatccacatgtcattcaggaggcagttttttagtttccatgtatttgttggaaaccattacttgttgctcaagtgaagtccagaaatttattacagaagttttcaaagaagttccacttgaagaacaagggagtctgttttttggctgacaaacattgtagttttatgaattacatacattatcatcactcacggtgtgcagaattacttaatttcacattgccttggtggcaaacaatctgtgatgataatatcaaagaaccagaaaaaataatgaatgaatatgataggcaaaaataaagactttagtctctctctcaatatctagaacgcatcaaccttcatcagtaatagaaacaacataattagatcaaaagcatactacacacttatgtccaccctacctctccattgaaagtacccagctcctttagccagaacatataccagatctttgactgataagtttaacagcatgttaacagttccagagggttgagaaaggataaataatccacaaatacttcaaattatccttgttaacagtgactggtttctgttgtaactggactgaacatgatgaaaaaacataaaatcgattttttcacatactgctgataagaccttaactttgtacaaggtgacatcatcatcacactgtctctgaaggaaaaggtggctgattttatgggaatttaggcatggggttggttatcattctcatatacagatttgctagaagaaaatgagaaggaaatagtgactatggcagctccatgtcctgaatccatccataggattagcattattagcatggtgagtttatctgagaaatgtagggtcattccattcaccaaattctccaaaacattatttggaatgtttgtcaataagagcagctgcttctaaaagtgattgtacttttgaggcacatgtgtccaagctagaaatcatatctcctaaaaatttaaaggtagcaaaactgcctaagtggagaaaacctcttggctactgtgaaactctgatcatcagtggtaaatgatccacagtaccaataatatgtgaaaaacattattgaaattcaccaagatcaaatgcaggtaaaggaatgtgagtgtggacacttcaggttgttggtcccaggatccttcctgttgagttaagtaaaatcatagcttgtctctcccaggatagcaaaatagataattctaccaaatgttaatgacaggaccatgttatttctactccaggactcacaaaggggaacataaagtttaagttatcctaaatgcagttgttttgaggggagatgctccagccaggaaagaaattgtaagtgtgtttaattaaatggctcattacttctctcaccatttaagagttgagacatctttgttttctttttttattttattttattattattatactttaagttttagggtacctgtgcacaatgtgcaggttagttacatatgtatacatgtgccatgctgttgtgctgcacccattaactcgtcaattagcattaggtatatctcctaaagctatccctcccccctacccccaccccacaacagtccccagaatgtgatgttccccttcctgtgtccatgtgttctcattgttcaattcccacctatgagtgagaatatgcagtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaatcaccacactgtcttccacaatggttgaactagttgacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatatccttcgcccactttttgatggagttgtttgtttttttcttgtaaatttgtttaagttcattgtacattctggatattagccctttgtcagatgagtaggttgcaaaaattttctcccattttgtaggttgcctgttcactctgatggtagtttcttttgctgtgcagaagctctttagtttaatgagatcccatttgtcaattttggcttttgttgccattgcttttggtgttttagacatgaagtcctggcccatgcctatgtcctgaatggtgatgcctaggttttcttctagggtttttatggttttaggaataacgtttaagtctttaatccatcttgaattaatttttgtataaggtgtaaggaagggatccagtttcagctttctacatatggctagccagttttcccagcaccatttattaaatagagaatcctttccccattgcttgtttttctcaggtttgtcaaagatcagataggtgtagatatgtggcgttatttctgagggctgtgttctgttccattgatatatatctctgttttggtaccagtaccatgctgtttttgttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcaggatggggatgacattgaatctataaattaccttgggcactatggccattttcacgatattgattcttcctacccatgagcacggaacattcttccatttgtttgtatcctcttttatttcattgagcagtggttcgtagttctccttgaagaggtccttcacgtcccttgtaagttggattcctaggtattttattctctttgaagcaattgtgaatgggagttccctcatgatttggctctctgtttgtctgttattggtatataagaatgcttgtgatttttgtacattgattttgtatcctgagactttgctgaagttgcttattagcttaaggagattttgggctgagacaacagggttgtctagatatacaatcatgtcatctgcaaacagggacaatttgacttcctcttttcctaattgaataccctttatttccttctcctgactaattgccctggccagaacttccaacattatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaagttcttttttggttgtgtctctgcccggctttggtatcaggatgatgctgacctcataaaatgagttagggaggattccctctttttctgttgattggaatagtttcagaaggaatggtaacagttcctccttgtacctctggtagaatttggctgtgaatccatctggtcctggactctttttggttggtaaggtattgattattgccacaatttcagagcctgttattggtctattcagagattcaatttcttcctggtttagtcttgcgagggtgtgtgtgtcgaggaatttacccatttcttctagattttctagtttatttgcttagaggtgtttgtagtattctctgatggtagttggtatttctgtgggatcagtggtgatatcccctttatcattttttattgcgtctgtttgattcttctctcttttcttctttattcatcttgctagtggtctatcaattttgttgatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttaaatgtgtcccagagattctggtgtgttgtgtctttgttctcgttggtttcaaagaacatctttatttctgcctttatttcgttatgtacccagtagtcattcaggagcaggttgttcagtttccatgtagttgagcggttttgagtgagtttcttaatcctgagttctagtttgattgcactgtggtctgagagacagtttgttataatttatgttcttttacgtttgctgaggagagctttacttccaagtatgtggtcaattttggaataagtgtggtgtggtgctaagaagaatgtatattctgttgatttggggtggagagttctgtagatgtctattaggtctgcttggtgcagagctgagttcaattcctgggtatccttgttaactttctgtctcatggatctgtctaatgttgacagtgggttgttaaagtctcccattattattgtgtgggagtctaagtctctttgtaggtcactcaggacttgctttatgaatctgggtgctcctgtattgggtgcatatatatcgaggatagttagctcttcttgttgaattgatccctttaccattatgtgatggccttcctttgtctcttttgatctttgttggtttaaagtctgttttatcagagactaggattgcaacccctgcctttttttgttttccatttgcttggtagatcttcctccatccttttatttggagcctatgtgtgtctctgcacgtgagatgggtttcctgactacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagcctcgatggtctttacaatttggcatgattttgcagtggctggtaccggttgttcctttccatgtttagtgcttccttcaggagctctttcagggcaggcctggtggtgacaaaatctctcagcatttgcttgtctgtaaaatattttatttctccttcacttatgaagcttagtttggctggatatgaaattctgggttgaaaattcttttctttaagaatgttgaatattggcccccactctgttctggcttgtagagtttctgctgagagatccgctgttaatctgatgggcttccctttgtgggtaacccgacctttctctctggctgcccttaacgtattccttcatttcaaccttggtgaatctaacagttgtgtgtcttggggttgctcttctcgaggagtatctttgtggcattctctgtatttcctgaatttgaatgttggcctgcctcactaggttggggaagttctcctggataatatcctgaagagtgttttccaacttggttccatctccccatcactttcaggtacaccaatcagacgtggatttggtcttttcacatattaccatatttcagatatggtacataaaagctatttgtttttagggtagtgggattatgggtaatagttaatttttaaaaattggactatctttacgattactattaaaagtagaaagtgttttgtaattgagggttctttgcttatctgtgtaatatgagatgaccaaatcagtggtgcatgagaagggtcaattttgttgtacaaatgcctgaagaagagctggatataacattttgttcagagccaattagctgtgatttttttatctgaaatgttacagcttatttttcaagcctaaattctctctgtgctatggggttacttcaggcagtctcaatgtatgaccaaaggcagagtgtttaatttgctgataattattacaggcccctataattcataagtatatttttagattggggaggggaggaggaagcaaacattttgtataactgtcataatttgcacattattacaataaatattttacagttaattaaaatgttctaaattagagaactatgttacgtatgaattttaatatattattagactattaaatttagtcttcattattttcttagcttaccagttgtgaaagtgtaataacaaatgggctgtttgctgtaattgctctttgctgtaattaatttataggttccatgttaaggaagctattctgcttagaaacatttgaaagttttaagtgctgactaggaaattttaaaatgttatattatctgaaaaagattttcttgacagacaaatcagcatctctgccaggttttgcatcattatttttggcaggataattagctgtaatgccagaattcagatatatggtagttggagttatagatgatccaaaaattcattctcaaactgtgatttatctcacaaccataggaagtagggtgtagattacaaataactaggtgtgtacgtggttttaaagctacccaaataaaaataggtagcctaataaaaagatgagagcttttgaactattataactttgattattttaagttaacaaaacattcaaagtcttagcactctgtcaagattttggcagtacataatggtatatatacagtacagtaatgctcagcatttcttgagggaaaaggtataactttggacagtttctgacatatgtatcttttacccatgagggagtagttgaagttacagcctaaaggagttaactggtagaataagatttctgaggaggtggttagtaaggccaacttaaatggttgtgcataaggatactgggccaagtgggtgaggagggactgaaattgtgtgctttgtctgctaaacctgtgcccttgtgtagagattgtgtacctagaggaggagcctttctcttaacaaagtgtaacagcatgagccctcagaggctctggtggacagagatgagttccagaggccagaagtgattgattcctgttccgtaatgatagtaggagtgtagaaaggaaaatctaaagagtctccttcaaatatttgtttaatattttattcagagtaaggagatatttactttctagtaagaaatattgcatacctctgtatgttcataataaaagatttattaacatgcacagaacatagtttaatattttaatttatatgtatttttaaaaactcattgatatactaccactgaaaattaggtaacattatttattcacactcattaaggattggggtagtggcctatacttgatctgactcctccctccctttttgaagtcatctcctgtaatttacttccttgttcatttcagccacagagaggtccttgtttctgtttttggtacttgccattttcctctgcttagaatgtgctgttctctactcttctctatctttgcatggctatttcctttttatcctttaggtcttttgtacctcagtgtggcttttccttacttttaatctctattggcaacttctttatccccagtcttctctatgtgtccccctatgttattctaaaaatagtgtttattatgtatcatcttcatttataagtttggtatctgttcctcctagaatgtaaatcccacaagagcagggaccttgtttgtcctgtttaccattatatccttggtttcccagaactgtacctggtatataattggtgctcaataatattgttgaatacattattaaagtcgaaaactcttgttcaaaatatattttcaggttacttttatggtttttgtgttggcaacatgcttctcacttttctgtatttttttctttaatcagttttcttgtgctgttttctgaaccagacagcttcctgtgaggcatattaaagatttcaaatttaaatttaaaaaataaattacttgctcctggtaaatagcaccgtgcaatgcatggtttaatttcaagttttctggagattgtgactatcagttttaagtccctgttaaccatctggatcaggattggtggtacaaccttcagtagtactgtatagtacagtctgcaaaaatatttgatgaggataggttgatgttggcaagaggtattaaaattttttttaaaaatgctttcaactttgaggacttagggaccattacacatttgcctggttatgaagcagttgcattaaatggttctttattatcagtttattccagtgatgttatagtgccacttgaagactggtgctcaggcttctatttggtcagtcaaccctttaatccagctccgagaaatggatagttatgggtatatgtcactttaagtgtgatagcgagaattcgaggagttcttagctgatgtcttttactaaaatagcaggcaaggtcatttgctgagaccaagcagagaaacagcaggatgggaggtgtcaggaaagtaaagaagaatgggagggaactgactagggaagtgaagaagggttgtttggtagagctgagaaccaaactgagataggtaactgtgcattttcagtggtaccagtctgttcatttgtgtgaacaactggaatggtaaatatcataaacagttttttttttagttctttagtaaatgttttacagttgaaataaaaaataacactgtctaatggggttttcaatgtgtatagatatatagataactataacacaaaggggagagcaaaaggacctatatgatggtaatgtttctgtagtctactttaattgttaaattgtgattctaagaagactgagtagtttttattgtaatccctaaagctaccactaaaaaagatacaaagatatatagtaatagcacaatagataaatttaaatcaaatactaaatagtattcaaattgtcaaaaaggcaggaaatgggaaacagaagaaaacagagacaaacagaaaacaataaaatggtagtcctaaatccaaacatatctgtatctatatctatatgcatataagtggtctaaatacaagaactaaaatacagcaattgtcagattcaataataataataaaaagaccccacaatatctgtctatacaagaaacccactttaaatacaatgatacagacagattaaaacaagaggatggaaaaagatataccttgcaaatactaatcaaaagatacttggatgatacctcaccaaatagatttcagtacaaggaaaattagtaggtgcattacgtactgataaaggggtctatttgccaagaagactctaccaatttaaaacaactgtgtgcctaacaacagtgctttgaaattcatggagcaaaaactggtagaaaggagaaatgggaaaatccacttgtaggtggagacttcaagactcctttcctatccactccaatcactatcctaagtgatgaagaaagaagagagaggccgggcatggtgtctcacacctgtcatcccagcactttgggaggccgaggtgggcagatcacttgaagtcaggagttcgagaccagcctggccaacatggtgaaaccccgtctctactaaaagtacaaaaattagccaggtgtggtggtacatgcctgtagtctcggctactcgggaggctgaggcaggggaattgcttgaatctgggaggcagaggttgcaatgagccaagatcataccactgcactccagcctgggtgacagagtgagagtctgcctcaaaaaaaaaaaaaaaaaaaaaaagagaagatcaacaattgaataacatcatcaatcaactagatctaattgaatttaaagaacatatcacccaagagagccaaatatatattcttttcaaatactcatggaacataccaagataaggggtcagcaaatattttgtgtaaagtgccagatagtaaatattttaagcattgtgagccgtgtggtctgtgtcacaactactcagttctgtcattgtagtgcaaactcagccttagataattcataaataaatgggtgtgactatgttccaataaaagtttatacattgacactgacatttgaatttcatgtaattttcacatcatgaaatattcttcttttgatattttcagtcatttaaaatataaatataatccctagtacatgggccatacaaaaattgtcagcggctgggtttggtgcaaaggccgtagtttgcactcccctgaccaaaataaacaatattctggttcataaaacaaaccttaacacatttaaaaacattgaaatcctgcaaagtctgttctctggcagtaatggatttaaactagaaaaatatcaaaaaaagatatctagaaagtctgaaaatatttagaaagtaaacaacatagttctaaataactcatgggtcaaagacatctcatgagaaattgacatagtttgaattaaatgaaaatacaacataacataatttgtgggatacagaatacagggaaatttatagcactaaaaatagacagaaatttattatttttatttctatttttatttttgagacagagtctcactctgtctcccaggctggagtgcagtggcatgatctcagctcactgcaacctttgcctcccaggttcaagtgattctggtacctcagcctcccaagtaggtgggactacaggcacgcaccaccacaatgcctgactaatttttgtatttttagtggagacggggtttcaccatgttgggcaggctagtctcgaaactcctgacctcaggtgatctgcccaccttgacttcccaaaatgctgagattacagtcatgagccactgtgcctggcctaaaaatagagggaaattaatagaattaaacgcttatgttagaggcgtttaaaccggagcaactccatcttgaataggagctgggtaaaatgaggctgagacctactgggttgcattcccggatggttaaggcactctaagttacaggataagataggaggttggcacaatatataggtcataaagacattgctgataaaacaggttgcagtaaagaagccagcaaacccctccaaaaccaagatggtgatgagagtaacctctggttgtcctcactgccacactcccaccagtaccatgacagtttacagatgccatggcaacatcaggaagttaccctatatggtctaaaaggagaggcatgaatagtccaccccttgtttagcgtataatcaagaaataaccataaaaatgggcaaccagcagccctcaggctgctttgtctatggaatagctattcttttattcctttactttcttaataaacttgctttcactttgctctatggactctccctgaattctttcttgcacaagatccaagaaccctctcttggggtctggatccagatgcctttcctgtaacacttagaaaagaacaacttggctgggcgtggtggctcatgcctgtaatcctagcactttgggaggccgaggtgggtggatcatgaggtcaggagttcgagaccatcctgaccaacatggtgaatccccgtttctagtaaaaatacaaaaattagcagggtgtggtggtgcgcacctgtaatcccagctactcgggaggctgaggcagaggaattgcttgaacccgggaggcggaggttgcagtgagctgagatcgcaccactgcactccagcctgggcaacagagcgagactccagagcaagactccatctccaaaaaaaaaaaaaaaacaactcaactcaataatctaagcttctgtctttggattttccatatagacagttttcttcttttcattatgctactgtatgattttctagttgatttgctattccttttatcttgttcattctttttttttttttttttttttttttctgagacagagtctcgctctgttgcccaggctggagtgcagtggcgcgatctcggctcactgtaagctccgcctcctgggttcatgccattctcctgcctcagcctcctgagtagctgggactacaggcacctaccaccacgctcagctaattttttgtatttttagcagagacagggtttcaccattcacaggatagtcttgatctcctgacctcgtgatctgcccacctcagcctcccacagtgctgggattacaggcgtgagccactgcgcccggccttatcttgttcattcttaaggtctgggtccttaccccaactttctatttgctctactgcaatatggatgaatttttctagacttctctgtgaccagtttgtcttttctgagctacagtttggtggttggataatgccttgtacctgctttctgtactcgtaaagttgggaatgtgaggggagtagggagagttattcagctgaggttttgcaagtttttgtaaaggacatgggttttgtttcctctttcaggttttattaagtgtccttgaccagggttcattcctcctgatgagtgggtatccttttcctgtgtgggatgtgctcagggttgacatgttttcctccaatgtgttatgtaactctagtgccttttcttccattagggaaaaacatcctaccccattttacttactcatttccatctcaatacttatagtttataacaattcacattccttttgtgtttggttttggtaaattcctatttaatgttgggtatagttggttgggtaaattcctatttaatgttgggtaaaatagcctgtattttaaatgatgcgtctgagagtacctcatttcctcgctagaatctagcttttttatgtagagtttgtctactctaaaaatattttcatctgggtgtggtggctcacgcctgtaatcccagcactttgggaagccaaggtgagtggatcacttgaggtcaggagtttgagaccagcctggccaacatggtgaaaccctgtctctactaaaactacaaaaataagctgggtgtggtggtgcatgcttgtagtcccagctacttgggaggctgaggcaagagtattgcttgaacctgggaggcggaggttgcagcgagcccagattgcaccactgccctccagcctgggctacagagtgagactctgtctcaaaataaataaataaataaataaataaataaatataaataaaaagatagttttggtttcttttccatgagccacttactcacttattcatttcctcagtctgcttttttccaaattggggcaccagtgagaaacctcataatttttatttttgttaccaaaataaataaatttaattaattataatgtgcagcaataaaatattttacatatttatgggatacatatgagtatttttacatgtatagactataatgatcaagccagggtatttggggtatccatcaccttgggtatttatcatttctaagtgttgggaacatttcacatctgctcttctagctactttgaaatatgcaatatattgttgctaactatagtcaccctactctgctattaaatattggagcttatttcttctatctaactgtatgtttgtacctactaaccaacctctctttatgccactctcccacccacactcaccccactctctggtatctatcattctattcactacctctgtgggaccaacatttttagctcctacatatgagtgagaacacattatctgtctttgtgtgtttggtgtttggttttgctaaattcctgtttattgttggggatagttagcactgcctgtattttaaatgatgtgcctgagagtttgtgtgtctggcttatttcccttaacataatgtcctccagttccatttatgttgttgcaaatgacaggaattcattcttcgggctgactagtattccattgtgtatatataccaccatttcctttattcatttatctgttgatagacacttaggttggttccatataatggtgccatataatatgccagtgcaggtatccttttgatatacagatttcttttccttggataaatatccattagtgggattgccagatcatagggtagttctgtttttagttttctaaaaaatgtccatactggttttcatagtggttttactaatttacattcccaccaactgtgtataagaattcccttttctcagcaccctcaccagcatctgttattttttgtctttttaataacagccattctaactggggtaagatgatctctcactgaagttctcatttgcatttccctgataattagtgatgttgaacttttatcttcataaacttcttagccatttgtttgtcttcttttaacaaatgtctattcagatcctttgcccattgtttcaggggattttttttcctgttgtttgaatttcttgtatattctggatgttagtttattaggtgaataatttgcaaatattttctcccattcaacaagttgcctcttcactctgttgattgtttcctttgctgtgcaggagctttttggtttaatatagtcccatttgtctatttttgtttttattgtctgtgcttttgaggtcttaggcataaaatctgcctaccaattgtccttaagtgtttcccctatgtcttcttccagtagttttatggcttggggtcttatatttaagtctttaattaatcttgagttgattttacacgtagagaagggtccagtttcattcctgtgtgtatagatattcagttttcccagcaccatttattcaagatcgtgttctttccccaatatatgttcttggtgccttcattgaaaattagttggctgtaaacatgtggatttatttcttggttccctcttctgtttcattggtctgtatgtctgattttataccaataccatgctgttttggttactatagccttttaatatattttgaagtcaggcaatgtgatgcctctcactttgtttgctcaggattgctttggctattcatgctcctttcttgttccatatgaattttaggatttttttttaattctataaaaaagacattggtattttgatagggattatattgaatctatagattgctttgggcagtttagtcattttaatgagattaattcttccagtccatgagcatgggatgtctttccatttgtttgtgtgtgtactcttcaatttatttcattaatgttttgttgttttcctggtatacatatttcacctccttggttagaagcattactagatttttttttttgtaactattttaaatgggattgctttcttgattgctttctcagctagttgattattggtatatggaaactactgatttttttatgcagattttgcatacaattattgaatttattaatctaatccaggaagtttttggtggaatctttaggtttttctaaatataggatcatatcagtaaaggagtacaatttgacttcctcttttccaatctggatgccttttatttctttctcttgcctggttgctctggctaggacttacattatgacattgaatagaagtggtaaaagtggacagcctcgtctttttctagatcttggagaaaaggcttttagcttttttcccgttcagtatgatgttagcaatgtgtttgttatacttggtctttattattttgaggtatgtttcttctattcctagtttgttgagagtttttaccatgaagggatgttgaattttatcaaatgccttttttctgcatctattaagatgatcatatttttttttccttcattctgttgatgtgatatgtcacatttattgacgtttgcatatcttgaaccatccttgcatcactggtataaatcccacttggtcatggtctattgcctttttgctgggttgctggattcagtttgttacaatgttgttgaggatttttatatctatgttcatcagggatattggcctgtcattttccttttttattgtgttattgtctggttttagtatcagggtgatgttggcctcttagaacgagttagggagagcttcctcttcagtgttctaggatagtttcaggaagataggtattaattcttctttctacagtaatagaatttgactgtgagtatatccagtcctgggcttttctttggagactttttattactaattcaatcttgacactcattactggtctgctcaggtttttgatttttgttgttgttgttttttttgagatggagtctcactctgtcaaccaggctggagtgcaatggtatgatctcggctcactcaacctctgcctcccaggttcaagcaattctcctgcctcagcctcctgagttgctgggattacaggcatgtaccaacatgcatgctaatttttgtatttttagtagaaatgaggtttcaccatgttggtcaggctgatctcaaacctctggcatcaagtgatctgcccctgttggtctcccaaagtgctaggattacaggcatgagccagcacacccagcctgctcaggttttctatttcttcttgattcagtcttggtagcatgtatattttcagcaatctattcatttcctctaggtttttcagtttgttagtgtagagttgtatataatagtctgtgatcttttgtatttctgtggtatcagttgtactgtttcatttttctgattttgtttatttgagtcttctctctttttttttcttggttagtctaactagcagtttagcaattttgtttatctttttgaagaaccagcttttcattttgttgctcctttgtattgttttcttagtctctattttgtttagttctgctttgatctttattctttctttctgccaatttggggattggcttgttcttggttttctagttcctttaattgtattgttaggctggttttttttgaaatgtttctacctttttgatgtaggtattgtaataaaattccctctttgctgtaacccaatggttgttcaggagcatgttgtttaattttccacatatttgcatagtttccaaagttcctcttggtgttgatttctacttttattttattgtggtctgagaaggcacttgatatcatttagattttttaaaaatgttgacttcttttgtggcctaacatatcttagagactgttccatgtgctgataagaagaatgtatattcagcagttgtttgataaaatgttctgtaaatgtctttaggaccatttggtctaaagtccagtttaaattgaatgcttctttgttgattttctgtgtacatgatctgactaatgctgagaatagagtgttgaagttccttactattattaaattggagtctatctctctctttagatctagtaatattgctttatgaatctgtgctgcagtattgggtgcacatatgtctagaattattatatcctcttgtgggattgatacctttatcatcatataatgacattctacatcttttaaaaatgtgtttgactcgaagtctgttttctctgatgtaagtatagattcttctgcttgcttctggtttctgtgtatacggaatatttttttccattcctttgctttgagtctatatttgtctttacaggggaagtgcatttcctgtaggcagcatatagttggtccctgtttctttatccattcagccagtctctatcttttaagtggagaatttaatctgtttacattcaaggttattattgacatgtgaggttttttatttgttcttgttaattgttttcttgtggttttctgtattctttgtgttttttttctttttctgttattgctggttattgtagtttgatagttttctatagtgataccttttgagtcctttctcttctttatttgtatttggtttatgagtgagttttatagtttcatgtgttttcttgatgataaatgtcatcctttcatttccaggtttaggacttccttgagcattttttatagatctggcccaggggtgatgaattcccttagtgtttgcttgtctgggaaagaccttatttcttcatttatgaaggcttattttggtggatatagtatccttgcttggcagtttctttctttcagcttgttgaatatgtcattccattctcctctggggtgtaaggttttagctgagaaatccagtgatggggtttcctttatagatatatcgatacttgcctctttctgtttttagaatcctgtctttgtctttgactttagacattttgattataacgtgctgtggagtaagcctttttgcattttatctgttgggggaatctctgaacttcctggatctgcatgtcagtctcctgccagacttgggaagtttttatcaattattttgtcaaataggttttctaggcctttcattctccctttgcccttggggacaccagtcattcaaatatttggttgctttatgttgtcccagatgtcacaaaggctttgcttattcctttaaatccttattttttctttatttttctctcattggactatttcaaaaaacccgtcttcaagttctgagattctttcttctgcttaaactagtctattgttgaagcttttgaatgtattttgtatttcaattaattctccattccagaatttgtttgatccttttaaaaaatatctatctggtagatttctcatgcatatcctgaattgtttttcgaatttctttgtattgtttttcagaattttcttgtatctcatcgagcctctctaaatgagcattttgaattctttgtctaaggtttaacgaatttctttttaattggtatctgttgctagagaattattgtgtttctttgggggtgtcatatttctttgctttttgtgattcttatgttcttttattgatatctgtacatctggtgtaactgttgcttcttccacatttttgaatttgcctttgtagtggaggactttttcctgaagatgtatctatgaccttggttgggtagggcactttggtgttgattcaggtgcatgcagtagtgtagttcctgtatggtttctttggctataaacagtgttagtggtacctgtgacttctgtgtagcttaggtgcaattattagtggaggttgtgctgaagttttgctcaggactgggatgccaggtaggccagtctttgggccccaggggtggcagtggtagactgaagtgattatcctcgagccctggagtggtgtatgctgattctagcattagtgggtccagatggctggttcctgggcctccaggtggtttgcttggatgctggcactggcagtggtaggccaggcatgtggggatgttcttgggctcctgggcagcaggtgtgatgtgggtgatggtagtggcagtggtggggcaaatcactggaacccaagtggttcaagctgctgttggtggtggctgcaatgggttgggaagaccaatcctctgatccacaggtggcatatgtgtttgggtgccagctgtggtggtattgaccagttgcatcagcctgatctcagacctcaggaggagtgctcagatgtcaacagtgatgggctgggttgggcaatttttaggcacctggacagcatgctcaagtgttagggggacacactggtccagcagacttgttatcaggtccctggtagtgtgtttaggcactagctatgataataggggtggagttgtctctaggccactggaaaaatgctcagatagggacagtggcaactgtgctgcagaagcctgccactggggaaagtggggccactctcagtgggagcagcaaacgcagacagttctggagtgtatgattttcttgcacttcagtcctgcaacagcttgcagcagcagcagtcatcggatttgtctttggggcacatgaaagtgctcagcctcccctctccctccttggcctgggagtagcagcagtagcatcggctccagggcaggacacagtcctttcgggactagggtctcagaatggtgccttgtggtagctactcaaggcttaggggcctgtgggtcacagtgtcagctccctctctgtagcaatgcctctgcacaatctttaggcagctccctatgtgagtctcaaggcccatgagtgtcaaggggctctcctctagctaggattgtaagagtttgtggcaggagtgtggacccttggggtctctgacttaccttttctctgtgtcacagagcttctcctggcttccagtgcatcttggccaaggaggctgcctcatttctgtcctttccttgctttcggtgcttcctagaacttctcggttgaattccagtgttttctcctagaggatctattctaactgtaagtatctatatgatatttggttcctttccatggatgaggtgcatactagtaggatctagtcagtcatcttgaatcaactcgcctcatgatttttctgaagctgcttcttttcttagaacctcttctttgggatagagattatagccatcccacacatttccttagttattattttttgaagattcatagcatatcgtttagcctttactgtttgtttttttttgccatttaaagtactcttaaattgcttttgttaggctttgacaaagagaaactgtgatgtggttttactctgccttccaaccagctctcggaagacctataatttttgtacttagaaaaattaataaagatatttctactttagaaggtagaatataaagttttcaaaaaataaaatgagacatatttgaaaaattgttcacaatataataagtgcaatgaaaatagcttgtcaaatttacaaagaaaaatgaaaccgatatattgaggattcagtttaaaaaatgccacatacaaacatgtttcctcagaatttataaaacttcgtggaaaacaatgtggtaatgtattttacaattcttaaaaatacttattttctttcacacaacattccagtttgtcctaaggaaataaccagaaatatgtatatataaacaacaaaaagacattagtattaatataaaccttaaactgaaaagtgattaaaatgttaatcaacagataaatgtttaagtgtaattacaaaatgctcattacaaaaaacaggatggtaaactatacatattatgtgaccctagttttataagaaaaatatatttataatgacaatgaaaggaagcacacattttttattttattttttaataacttacgtaattttttcaaatgttccatcatgaatatatattcttaaatttagaggaaaaataataagattaagagatatctgttctctgatggttctagagctgggaagggttgcagtggaagaaaggttggttaatgggtataaaatagatggaaggaaaaagtgctagggttgtatagcacagtagcatgactatagttaacaataatcccactgggccttgtgtttaagagcagggtctctgaagccatccttgttgaagacagttttgcccaaggggatatcacagagtatttgtgggcatgaaatgattgtatttataaatttgcgcaacagacttgatctttgaccttttggtgatcttcttgcctatggcacctgtcactttgtagggacagtggtcaattccagacaccagagatacggttgtaggggtgatctgaagtgccgtcatcgatgttctacatgatgatgtgttggctttgagtccagagtagcatcaggccaggaccagcaccactctcccaggtttcacaaacttgcccatttcgacaacaaccaagtaggcctacatcagaaaggaagaaggggcacttctgctaactgtatatttcaaaaaagttagaagatttgagatgttcccaaaacaaattataaatgtttgaggtaatagatatcctaattaccctgatttgatcattgcacattgtatgcatgtataaaactatcatatgtactccatacatttgtataattatcaataaacaaatttaagatatctattgcatatgaaagaaataaaaagaaatgaatgcaaacttaagtattcataagaggataaaaatatgagtttaaagtgataagatagcaaaaatggtaagacaataatgtatgctaagattaatcaatataagccaattaaaaccagaaggtaaaagattgaataataaagtgatacaatgtttaaataatataataaaataatctaatattaatgaattttaaaaacaaaatcacactaaactgaaagaagtaaataaggtagatacccagattaaatcttcacgttaacattctgtaagaatgagaataaaaagagttttctgagctgaggaagtttcatagctttagtgactgtctgaagattgctgagaggtagaagacaatatctatttaatggtgccattttcccctggtttctcacacttgaaaaagcagcagctcttagatattttaaaaggaatataaggagttttggggttgtttctttgttgtcatgtttttggaagttcttagttacggtctcatcgtgaccatctcagaatgatagcctcagacccacagtctacatgacttctggctctcccacacgtaattaagtgttcatgttctaattccaaatccccaagaaagagtatctaattgcttcagtcatttatgttctggggacagggttgggagtgaaggaacagggtcaaatagtacaaaggatctgttccttccagggttataagcaggacagattctcaaagaagaaattattggcatctctgatacatgttgtgaataattttaatttttatatgtaatgtgaataatcacagataaagcaaaggatttttttttaagtctcagtgtcttccactgtacttgtgaattatgtgaacacagtaatggtagcttcatagagtggtcacaaaatgagaacatattgatgtctagatagaattatcttaagtaaatctctggattgaagatttcagcatgttctcacttatttgtgggatctaaaaatcatgtcaattgaactcacgaacacagagagtagtaggatggttaccagatgctgggaagcgtagtaggaggttagggaggaagtagggatggttaataggtacaaaaaaaaaaatagaaagaatgaataagacctactatttgatagcacaattgggtgactatagtcaataataacttaaatttattttttaaataacctaaataatgtaatttgattatttgtaactcaaagaataaatgcttgaggggatacataccccatttgtatgatgtgcttatttcacattgcatgcctgtatcaaaacatctcatgtaccctgtaaatatatacatctactctgtaccctcaaaaattttaaaaagttttaaaaaattataaaatgttatcaaatgatgattttaattctaccccataaaattaaataagcattgtatttcaccttttaaaataagtccattcatggtatgtagatattaaaactaaatattttaggaaaattgcttttgttctatgtacatgtttagcattacttcctgtgtaattttaaaatctgaaattcttctagcatacagagtaagtagattatgatatattgaaggattaagcttcactgtcttgtgtcagattaatctctcaaacatagattgtcacttgacctgatagaaatatgactgtaattcaccaaaaaaattcaatggataagtaaccatttcattattttatgtagaatgaagaatgtatgcttcttgactgattgtataattctccaaattaaatttaaataaacctcataatcacgcatttttctcagagtttcataaggattcatggaaaaggtatctctgatagcttatgtggtgaaatagaacaatatacatattctgtgattcttcccactttattaggcttaaagtgtgttaaagttactgaatgaggataattttgtatttttatataaaagtttctgcattattttaaacttaaattttctcatgaaacaagtacagataaacttttgcatttaaacaaaatagttaatactatgagaacattactccatttgcttatatgtttttgaatgaaataggtaaaattatatgcatataaatgaatgttaaaagggagtgtgaaaaataaagatagcagtgaggattatagtttgaaattaatgtgtatttaatagttaaaggaaatttaaataaagtaaagcaatgtgtttttgtcctaacgggaggttgcatgaaagaatttaaatgtatcatatttaggtaaatagttcagctatagagcagaaatattaacataaaaaattaattaaaaagttgaaaataaataggtgggcacagtggctcacgcctgtaatcccagcactttgggaggctgaggcaggaggatagtttgagttcagaagtttaagaccagcctgggtaacatagtgagaccctgtctctataaaaaaattaaaaattagtcaggtgtggtggcatgcacctatagtcccagcttctcaggaggctaagccgggagaactgtgtgagcctgggaggtgaggctgcagtgagctgtggtcgtgccactgcactccagcctgagtgacaaagcaagactctgtctcaaaaaaaaagttaaaagtattaataaacttttacataacacatgaacaatattatgtaatttatgttagaatccattgtaagaggataaaggaatactgcttttttcgaaaagttgagaataaaagtagaatactgaactagattgttaaaatctgatttttaaaatgaattgtattttaaacgtcatgacttgttttttacaagacctaatttttttttttttagacggagtctcactctgtcacccaggctggagtgcagtggcatgatctcggctcactgcaacctccacctcctgggttcaagcgattctcctgtctcagcctcctgagtagtaaacttcatgacttattttttataagacctaattttttttttagacaagagtcttgctctgtcacccagggtggagtgcagtggcatgatctcggctcactgcaacctccgcctcctaggttcaagtgatcctcctgcctcagcctcccgagtagctgggactacaggcacatgccgtcacacccagctaatttttgtatttttagtagagatggggtttcaccatattggccaggctggtctcgaactcctgaccttgtgatccaccagcctcggcctcccaaagtgctgggattacaggcatgagccaccgcgcctggcaagacctaatttttttagagcagttttaagttcacaacaaagttgagaggaaggtacagagatttcccatatatgtactgtccccacagatgcaatagcttccccccatcaacatcccccaccagaatggtgtatttgttacagatgatgactctccattgatatatcatcacccaaagtccatagcttatattagggtttactcttgatgttgtacattctctgggtcttgacaaatgtatgatgagctgtatctactctatcgtatcatataaaatagttttactgccctaagaatcctctgtgctccacctgttcatccctccttttcctgtaacccctggaacccactgatctttttattgtcttcatagttttccagagtccccttttccagaatgtcatattgatggaatcatacattatgtagccatttcagattgacttctttcacttggtattatgcatttaaggtttcttcatgtcttttcatggcttgatagctaatttattttagtgttgaataatactccattatttggatgtactacagtttatccattcacctactgaagggcgtcttgattgcttccaagttttgttacttatgaataaaactttgataaacatccatgtgcagcttttgtgtggacataatttttccactcttttggataaataccaaggagctcaattgctgaatgatatatatggtaagagtatgtctagttttgttgagaaaccacaaaactttcttccaaactgcctgtaccattttgtgttcccatgtacaataaatgatatttcttgttccacctccctgctagcatttggtgctatcaatgttctggattttggccattctaataagtgtgcagtggttatcttctttttttaatttgcatttccctcatgacatatgatgtggagcatcttttcatatgcttttttttgcatctctatgtcttctttggtgagaagtctgttaaggtctttggtccttttctttttttttttttcttttttttgagatggagtctcgctctgtcgcccaggctggagtatagtggtgcggtctcagctcactgccagctccgcctcccgggttcacgccattctcctgcctcagcctcctgagtagctgggactacaggtgcccgccaccacgcccagctaattttttgtatttttagtagagacggcgtttcaccgtgttagccaggatggtggtccattttttaattgggttgttttcttatttttgagttttgggaattctttgtatattttggataatagtcctttatgagataggtcttttgcaaatattttctcctagtctgtgaccatgttttcattctcttggcagtgtcttttgtagagcagaaatgtttaattttaatgaaatccagctaattgactcttttcttttataaatcatgtcttcagtgtcacatctaaaaagtcatcaccaaatctaaggtcatctagattttctcctgttatcttctaggagttttatagttttgtattctacattaaggcttgtgatacattttgagttaatttttgtgaaggtcttcctctaaatttatcttttttttttttttaataagagaaatctcgttcttgtcccccaagtttgagtgcaatggcttgatctcagctcactgcaacctccgcctcctgggttcaaatgattctcctgcctctgcctcccaagtagctgggattaaggcgcctgccaccacgcccagctaatttttgtatcttttttagtagagatggggtttcaccatgttggccaggctggtctcgaactcctgacctcaggtgatccgcccacctcggtctcccaaagtgctgggattacaggcgtgagccactgcacccggcccagattcatcttttgcatgtgggtgtccattgttccaacatcatttattggaaaggctatatatatatatatatatatatttttttttttttttttttttttttttacaatgtattgcctttgctcctttgtcaaagattaggtgactgtatttagtggctccgtttctgtgctctctattctattccattgacctatttgtccttcaccagtaccacactgtcttgattattgtagtgttacagtaagtctttaagttgagtagtgtcagtcctctaactttatgccccttcaatattgtattggctattctgagtcttttgcctctgcatataaacattagaattggtttgttcatgtttacaaaataacttgttgggattttgattgggatggcattgaatttatagatcaagttggaaaaactgatgtcttgataatattaagtcttcctatctatgaatatggaatatcttccaatttatttatagttttcctcatatagatcttctaaatattttgttagatttatacctaagtatttcagttttttggtgcttatgtaaatggtatcgtgttttttatttcaaattgcacttgttcattgctggtatataggaaagcaattgacctttgtatattagctttgtatcctgcaatcttgctataattgcttattccagatttcttgtgaattcttttggattttcttccatgattttttttaaaaaagcaaattggtagttatgtaactagggttatagttgtagattattaaaatatagaaatattcttagcaaaatcttgctacttctgaaagtcagcttttttggagttattttaggagatagcagatctcagtgaatttcagtcttcaaagtcatattaaggaaaaactatgttacatatatatttctcaaaattgtgataaatacacataacatataatttaccatcttacccattttaagtgtacagcttagtgggctatgtatattcacactgctgtgcagccaacctccagaactttttttatcttgcaaaactggaactctctatcaattaaataacaactcacaattttcctctcccctcatcccctggcaactaccattctatttttgtttttatgaatttgactattttggatacctcatataggtggaatcataaaatatttgtctttttgtgactaacttatttcacttagcataatatattcaaggttcatgtatgttgtagcatgtgtcacaatttacgtccttttttaggctcaatgttctattgtgtgtgtgtgtgtgtgtgtgtgtgtgtgtacagacatacataagcaccacattttgtttatgtatctgtcggtggacatttgggttctttttgccttttggccattgtgaataacaatactgttattaacatgggtgtacaaatatctatttgagtcactgcttaaaattcttttgggtatatactggaagtggaattgttggatcatatgatctttgtattttcaattttttgaggaatgaacgtactgttttctgtaatggctgtgcaattttaactttctaccaacagtgtataaatgttctacatccctggtaacacttgttattttctttctttcttttataatgtaatagccatcctaaggtatgtaaagtagtatgtgattgtggttttgattttcatttccactggcgactacattagcaatgttgagcattatttcatgtgctcattggccatttgtatatcttccttggagaaatgtctgttcaagttctttgcccatttaaaaatattttgctattttttgtgtgagttgtaggagttctttatatagtctagatattaagcccttatcagatatgacttgcaaatgttttcttccatttcatagactgctttttcaatctgctggtagtgtcctttgatgcacagaagtttttgatttggagtccagtttatctgtttttacttttgttgctgggctttatatccaagaaatcatcaccaaatcaaatgtaaagaagctttccttgtgttttcttctaatagttttatattttcaggtcttatgtttgggtctttgatcacttttgagttatttttgtatatggcataaggtaagggtccaacttcattcttttgcatgtggatatccagttttcccagcagcagcatatgttgaaaagactgccctttccctccccatttaatggtcttggcaccctcatcaaaaataatttgaccatatactctaaggtttatttcttggctctgtatttcttcaattggtctatatgtctgtttgtatatatatatatatatatatttaaataatataattaattaattagtattttctttctttctgtttctttttttctttttttcatagagagtctcatgctgtcacccagcctagagtgcagtggtgcgatcttggctcactgcaacctccacctcctgggttcaagcaattctcctgcctcagcctccatgagtagttgggactacaggtgcgcaccacatgcccaactaatttttgtatttttagtagaaatggggtttcgccatgttggccaggctgttcttgaacacctgacctcaggtgatctgctcacctcggcctcccaatgtgctggaattacaggcgtgagccaccatgcctggccaattagtatgttttaaaataaagtcttagttgtaaatttgatagtctttactaatgtagagatggtgaaacttcacctacattctcttagggtcctgactgggcccaataactaaactgatataagttagattaacgggagaaaagcatgcacatttattcaatataagttttatgtggcatgggagccttcataaagaaatgaagaactgaagaagctgttagagtcaattacttaaatactgaattggacaaagaacagtaagttgggaaaatgtgataaggcaaaggggattaggctaggatagctaattgtgtaggtaagtagccaggaagataagcgttggtgtaactaggtttgtttgtacacaattcctttggcctcagctttttgtcctccatggtaagaatgttgcatcttttatataggaatttcatttcttgccttaggaaccagcatgaatgtcatagcgatctttttttcacctgctgcttttcaagtgctctattaacttaaatagttaatatgccagaatggtataatttttttcattagtgagtcctgagattttcttttcttttcacagtaaccatagaaaaatcttgctcctaccccatctgcatcagtcccatttcccctgcatcctataggtaacgacgtcataaggaaatacacatatataaatcctattgtttctccttttttaaacttaatctatcttacagttactttttactgtcctaattacagcacatttttactttttaggttctatgatttgaagagtggtatggctatgtattacagcttgtaagttgttaccatattttggagcaaaatgtattattatttctactatttacatttaacatgaatcatgatcctaaaagcatcaaaatgtcttcataacatcctacaaggaagacagaacagcactgctgttctacactgtggctcttgcccagtctatagttacaagaaatagttctttagttgttgtgatgccctgggtaggcttcattcttaagtaatgtactttgtctatattaactccctgcaaatatgtatatgtgaacagaatatcttgaagatacatggtgaggtttggttgcctttgttctctgaagtcttttttttttttttttttttggagatggagtctcactttgtcgcccaggctggaggccagtggcatgatctcggcttactgcaacctctgccttctggcttcaagcgattctcctgccccagcctcccaagtagctgggagtacaggcacgtgccaccaggcccagctaattttttttttttgcatttttagtagagacggggtttcaccatgttagccaggatggtctcaatctcctgacctcgtgatccatccaccttggcctcccaaagtgctaggattacaggcataagccaccacgcccggtctgttctctgaagtctttacggttgttgtttctattattgttcccagcaagaactggaactgacctgatgtcatgatctatgaatataatttttaattaaggaagaagtaccaggaaatctcatgtcactatagacctgcttcgctgaataccatttagcagtctatactccagccaccaggcatattggttgtgcaatgatgcctccacgataactaacagtgaggagtagaagttgggcttagacactctggctcttgcataggtcgaggggtatgttgtgttcttgtaacaaatcccacatatacatacatatgcatattgttccacaaacatccccaagcagaaaccagagttaggggcagaataacctcaagaaaattttggttgctaggccatagatgcgtctttctgaggctggtattttgacactatgtgctccattgtttctcatctgctgtattgtgctgcatcaattgtttcaccacattatcactaaaaacttggtctccctaaaaacattaacttcttagggcctgtgtgccaatggggccttttggacttgacttcagctttttggaggacagagtccctttccccttatagtgctgggttattagtgaatcaaccctgaagaggtaaagggttggagcctcagcctcccaagaggctgtcactggagaatggtctcactgacctcagcccttgggcatttccatagcacattttccccctaacccctctactcctgccaaatgcctacctaactcttataataggaaagctgggaactccactcaaaaccatacaaaaaaccagtttgtacatttggacacctcccgagcactcacagtcactgtgtttctcttttccagcagcagacagtcactctcatgcagtttaagtgatttattgatgtctcagctaaacttgctttggtttcaggacatttcagccatcaaggtttttaaggaagagcattctgtaccagaggagccatgctgctttccttgtgtttgctaatgtgtccttagccagcctcattcttcttcagcttttctactttggcaacatagatcctcatggtgtccatcttagacatccctttgttcacattccatgcctcctacttggccttggctttcacatctgaggctgaaggggcagggatgttgcagtcgctctgggtgggctgtttgcagaagctgtacaccagcagttttctcctgatcgcacacagtacccttcagctgcttgagggcagtgtgggccagctcaaactccacttggcacattgtgggaggggaggccaggcccctctgtcctttctaggtgacacctggtgctagaaggctcatcaggtttcttcatcgatagagtagggatgatgatgatgatgtatcttcctcactgagtttcattgagaatccctatgtaggtacagggctatgtgtgttgtagcactgatcaaactctcagtagagagtggtataattataactccttaacaaacatttcaagatactaagaagaaagtataataccaagttttggttacacagccttttaatgaagcaaaaacttttagacattagcattccaagcaaagtttattctagcaataagacacaatgtgacagctaatataaattactgtggaaattacctcagatctgagaaatctggaaaatagttgaaaaagctcatgggtctattcctaaaggacaacctgtgaacctgtcagtgctaggacagatactacctagctgttcctgcctataccactcttcttactttagagctatggtagccccttcataatcctttcaggttctagcagaggaggaatatcaatttaattaatattctcagatttacaacatctgggaaataacagcatttataaatcatggacattatcaaagatcattcataatatattcttactatctaaacttggttttctgtacatttaacttttctagaggtatgtgaagtggggaaaatgggtactttaagaactatgatttgtttaattttcacctacataactggcaaacattttcattattattatcattatgtagaaaaacatagatgtatcaatatccatattttatctttagtatctcacaggaaaggtattttgggttaatgactatttacccggaaaatctggagaaaattctgcaatcttgacaaaaccctatttttttaaatacaattttttctctaaaaattagttaacttttgattatctgtgtgataaagaaggttgggaataggagaatgaaaatttgctggtaactcagtttggcttacatgttatgcattattaaaattttttcagagcaataacaaaatgaaaaatctaatttgagtttcacctttttttgtcataccctctggtagaggtacagataaatgggaagtagaaagaaaaatttgaagtataaaagccttcagtctgattaactttgaactctaagatttaattatataatgtaattattgtctaatattaaacaatgttgattattattatagatgtctataattttttttttttttttttttgcaacggagtcttactttgtcacccaggctggagcgtaatggtgcgacctcagctcactgcagcctccgccctccgggttcacgccattctcctgcttcagcctcccaagtagttgggactacaggtgcacgccaccacgcccggctaattttttttttttttgtatttttagtagagacggggtttcaccatgttgtctaggatggtctccatctcctgacctcgtgattcgcccgccttggcctcccaaagtgctgggattacaggcgtgagccaccgtgcctggcctatagatgtctataattgtgaaatatcagttatctgctaaagaatgggtgtcaataactgtgaagggtatgagattttaccctacttactagctaacaagttaccacactatagtttcatggatgctgttagaagacatgagactcctgagtcagagacaaatgatagtaaccagggtatcggcatttttttcttttcttcatggattctctgagccctattcctatagagcaatgttaagagggctagatgacacctgcacactcaatgggcagtgtaaaggagaggcattctgagtttaaagaactcaaatctcatataaaagttgataagcatgcctgcccctttctccagagggaaacagtatctgtgttctaaggggcagtcagggcaaattactcatagcagtaattcgagagaaccatggagaattgtcttctaacaatggatctgggctgaaaaatttgcataataaatactgtatttgtaatgtaaattaataatgtaaacaagagcagaagaggactttctttctttcttttctttctttttttttttttttttttttggagacagggtcactctctgttgcccaggttagagtgcagtggcgcgatcacagctcactgtagccttgaactcctgggctcaagcaattcttctgcctcagcttcacaagcatgtaccaccatgcctggctaatttttaaaattttttctagagacagcgtttcactatgttgcacaggctagtcttgaactcctgggctcaagtgatccttcagccttggcctcctaaagcactgggactacaggcatgagcactatgcctgccccctactgccccttttttaaagtacctgggagaacaaagtttaaatattctatttttgtagcacctaattaacatacaatttaagacactttcaaaattttacattattgaaaataagtaggttgaagacttttacttacgatcactttgctgttatgctgcatgtttttgaaataataaaactttattttgaaaacaaacactcaactcaaaactcttaactaatttatatgattcatactgtctcttgttaaaaatccacacgggggattttaagtctgtatcaggccatgaaaagtttagatatgaagaaggcagttttctttttttcttaatgtttacaccagaccaaagtgaatcattttgagagaaccaccatctctgatttcctgcaaataaacaaataaaaataatgtttaagcagagtaaaaagtaattgacttaacatttgtatctttattatttttaagtactgaaaaatagtgaaacaaaataaaatagtttaaaatgtactgcacatagatacataagataactgtatacttacctgacttggtcatcaaaattttgatacgatatttataaaaactagtcaagaaataataagcattaaaaggcaaagaaaggacaggatgttaattgaaatttagaagcatctgagggttcctccaatgaaaaattgcaaactgtgggtcatcatttggattctacagtgtgattttaaaatactgtgtgttctaaaaggtattatatagcatatatttcctaattttggtgttttactgagtatttgataatggctattgagataatagtttataaaatagaaaagattgtggttttataagactttcataacattttatgaagctgcaaagaaatattaacaacttcatctatttcccatttgttattctttcttttgcaccttctgcccatccctgtcagttacagaaaaacagaagatcttatgggcttctgaagttggatgatgtgtgaagataagactaaagatgagtgatattatgtgaaaaataatacagtggggacagtttttaaaatttgaagataacctacttagagttgaaatggtaaaagtaaaaggtaaagagagtagggataacagcacttacactatcatgtcataattggagacattttacttaaagtataggtgaaagtaattttaaaaaataaatttaaagttattctgtaagttatatcttaaaagttatttttactaagaaaagcctttcagaaagtctgcatttatactattttaagtagtcacatatcaaaggaaacagatatgcggctaaaaaataagggcaacacatgtatgtaggtatgtgcctgtagaccttgatgtacacaaaattgaaaaaaaaaaaaaaacctggaaaaacaggtagcaagaagaatgcgtaatttaatagtgcctgaggcttgagtgtgtgctggcaagttccaggcttttaggtagctttcaatttaaaaagaaaactaagcactgtcattttttaaaacataagcttcaactcttggcttataaactaccataccaaagtctagtttctataccacgagaatggtcattgagaaaatgagttaggttttggccttgttcatcaactggcagagatcctaggtaaattattttattttcttaatatctagatatacttgttgctagaaggctgatggcatacctaagaactatcgtgtcgttcagccatgttgctgttgttatgtagtgtcttctatccatgatttaatcctctcttaccttaggaattacattttaaaaagtaagaatcatagaattaacttctcaagatcttccaggatttaaaaaaacaaaacaaaaaatattcctttgggggattttctttaaaatccattgcattttaaaaagacttcagggcatttccaaggtttccattgctatataaccttgacttatactctacgtaccttagacggatattttgaagatttataaaataatttattttacattcaagtttttaaacattatttgaagtaaaacataatcattaaataaaatttggaaaacaggaaactatgaaaatttacccatagtcctactagttatacaaaactaaagttaacatgaatttgcttctagtctctttttctccacgttttatttatttattttaaacacagcttgaattatattgtgtatatatatatataattctgtatcttttcttttctttttttttttggccttataacacttcaaaactttttaatgttcctacatagtctgtttttaatggctgaattttattattccattaaatactatagctttatttaaccactccttttttggttaaatttatattgtttccaatttcttctttttcataaataaccctatgatagataggcatgaagtttttttttttttttctgtttgtaggattatttccttggtatagaactgtagaaatagaattattggaccaaaagctatgaaattttaagcttctggataaacactgtagaattggtagttttgctttgtttgtttcctagtttgggaggaggtgattttgttcaataataggaagttgtggttccaaggaagactgatcttcatttttttttttaatgtgttgaaattgtgctcagccttgactgaatgaaactacgtgttaattcttgtagtaattttacagcaacgaaagggttttccccagtccctcattgctttctacatgtggttaagtgcattttctgagccacacccttttgctgttacctaatattgggtgatatcaggtcactttcctttaaatgtacacagacttttgtaagtaaattcagcagacaagttaagctttgctttgctataaactggattttgacctgtggctcacttaatgcagatttttaaattttaatacagtaagtgatcatctcagtttattatgttaggtttcctctgtgttactaacagtctgtcttgaagtttctgatttggtttaataataattaaatcccagaagtataatattttagacatggaagaaatcttaaaactccctaatctgaaattgttttattttatagatgaacaagttgaggctcatatgggttaagtgttttgtccaaagtcagttagtggcagagttgggattataattttgttcgtatttctctgtaaagggtttttttttttccactatagttttttaatgtactaacaatacttgttccacaggctgctttatgattaacttctctgattccctattcctctcatttaaggcttttgcttataagcatgctagctagtggtccaccctatgtggcaggagacgcttttctgagtaagttgaccagctattcaagtttcactactgaacattgtgaaattgaactctgcttcttgcatatttggtatcatatataggtttctttttcatcaacatggcagagtttggtacttgacattttttgtagaaaatgcagtctcaaactgactgtagtctagcacttgccaaaggttggcttgaggcttctggtacatacgagagacaagttttatagataagctaactaactttctaacttctgtgttaagtaagccatcagaaaggagtgtacttagaacttgtcatttcacctttccacaggaatgcctttagtgaattatgatttaagtattttaccttataaagaggagttataataagaaacatctatgtgactagaatgtctatccttttcaaaactctaagacatgtttagtttgtttttcagttaaaaatttagagattgggtcttgctaggttctccatgctggcctaaaactcctgggctcaagcacttcccctacctcagcctccaaaggagctgggactgtagggatacactaccacacccagcttgcttttcagttttttttgttttgttttttaataagacggtgtcttgctctgttgcccaggctggagtgcagtggcgtgatctcggctcactgcaacctccgcttcccgggttcaagcagttctccctgcctcagccttctgagtagctgagactacaggcgcacgtcaccacatctggctaatttttttgtatttttagtagagatggggttttcccgtgttggccgggctggtcttgaactcttgacctcaggcaatctccccaccttggcctcccaaagtgctgggattacaggcgtgagccacctcgccaggctgcttttcagtttttttttacacaagcttttttttttttttttgagataaggtctcactctgtcacccaggctggagtgtagtggtacaatcaaggctcaatgcagccttgacctccgaggctcaggtgattttcccaccctagcctcccaagtagctgggactacaggcatgcaccaccacaccaggctatttttgtattttttgtagagacagggtttcaccattttggccaggctggtcttgaactcctggcctcaagtgatccgcctgccttgacctcccaaagtgctgggattacaggtgtaagccaatgcacctgggctgcacaaacattcttgagtgtgaatatagaatgctgaaaaagtgtttccatctagataaatttactatttgcatgtgttaaaaaattaataaaaacaataatcatgaaccatgttttagaacagaatggttttccattacctaatttgacagattaatcatgtaatattactaaattaaacataaccattctcattttacagatgaagaaacaggtatagaggtgtgtagcagtgaggaggtagtggaacaaaattagactgagacagtttgcttataatactgcattctttctgttataccatgatgcttctcaaagtaaacctatttcacttttttgcctttgccttcccaaattcagagctaaacacagttttaacttgtataaaacagcccgatattcaacatcacataactgtgcaacttgttttgtgtttttttttttttttttttttttgagatagggttgtgctctgttgcccaggctggagaacagtggcacaattatagctcacagcaaaagtacagctcaaactttcgggctcaggtgatcttgcctcagcctcccaagtagctgggactacaggtgtgcaccactgtgcctggataatttttttaaacttttatttttgtagagacaaggtcttgctatgttgcctaagctagtctcaaactactgggctctagcgaactttttgccttagcctcccaaatcactaggattacaggcgtaagtcaccatgcctggcctgcaacttttaattgacttttgctgtgtatataatttattttagatatgatatataaaatactttagtgaaatgccccaaatctttcagaaagtaaatagatcataaatgctgagataaagtatgttgacatatttaactttttttttttttttttttgagatggagtctcgctctgtcactagactggagtgcagtagcacaatcttggctcactgcagtctccgcctccaaggttcaagcaattctcctgcctcagcctcccgagtagctgagactacaggcatgagccgccatacccagctaattttttttgtatttttagtagagacggggtttcaccatgttggccaggatggtcttgatctcctgacctcgtgatctgcccgcctcggcctcccaaagtgctgggattacaagcgtg

SEQ ID NO: 12516 - DNA, 6070 bp, Homo sapiens
ttctttttttttttttttcttatttatttacttatttatttttattattatactttcagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccagtttcatccatgtccctacaaaggacatgagctcatcattttttacggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcaccctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtataaggaagggatccagtttcagctttgtacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttgataccagtaccatgctgttttggttactgtagccttgtagtatagcttgaagtcaggtagtgtgatgcctccagctttgttcttttggcttaggattgccttggcgatgtgggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccagttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttatacattgattttgtatcctgagactttgctgaagttgcttatcagcttaaggagattttgggctgaaacaatgggtttttctagatatacaatcatgtcgtctgcaaacagggacaatttgacttcctcttttcctaattgaataccctttatttccttctcctgcctgattgccctggccagaacttccaacactatgttgaataggagtgatgagagagggcatccctgtcttgtgtcagttttcaaagggaatgcttccagtttttgcccattcagtatgatattgactgtgggtttgtcatagatagctcttattattttgaaatacgttccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttggtcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagacggaatggtaccagttcctccttgtacctctgatagaattcggctgtgaatccatgtggtcctggactctttttggttggtaaactattgactattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatccccgttatcattttttattgtgtctatttgattcttctcttttttttttctttattagtcttgctagcggtctatcaattttgttgatcctttcaaaaaaccagctcctggattcattaattttttgaagggttttttgtatctctatttccttcagttctgctctgatcttagttatttcttgccttctgctagcttttgaatgtgtttgctcttgcttttctagttcttttaattgtgatattagggtgtcaattttggatctttcctgctttctcttgtgggcatttagtgctataaatttccctctacacactgctttgaatgtgtcccagagattctggtatgttgtgtcttcgttctcattggtttcaaagcacatctttatttctgccttcatttcattatgtattcagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtattgggtgcatatatatttaggatagttagcttttcttgttgaattgatccctttaccattatgtaatggccttctttgtctcttttgatctttgttggtttaaagtctgttttatcagacactaggattgcaacccctgcctttttttgttttccattggcttggtagatcttcctccatccttttattttgagcctatgtgtgtctctgcacgtgagatgggtttcctgaatacaacacactgatgggtcttgactctttatccaatttgccagtctgtgtcttttaattggcacatttagtccattgacgtttaaagctaatattgttatgtgtgaatttgatcctgtcattatgatgttagctggtgattttgctcgttagttgatgcagtttcttcgtagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagctgttagtctgatgggcttccctttgagggtaacctgacctttctctctggctgcccttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgaagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagttccatcagctcctttaagtacttctctgtattggttattctagttatacattcttctaaatttttttcaaagttttcaacttctttgcctttggtttgaatgtcctcccgtagctcagagtaatttgatcgtctgaaaccttcttctctcagctcgtgaaagtcattctccatccagctttgttccattgctggtgaggaactgcgttcctttggaggaggagaggtgctctgcgttttagagtttccagtttttctgttctgttttttccccatctttgtggttttatctacttttggtctttgatgatggtgatgtacagatgggtttttggtgtggatgtcctttctgtttgttagttttccttcgaacagacaggaccctcagctgcaggtctgttggaataccctgccgtgtgaggtgtcagtgtgcccctgctggggggtgcctcccagttaggctgctcaggggtcgggggtctcagggttcagggacccccttgaggaggcagtctgcccattctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatgatgggcgcccctcccccaacctcgctgccgccttgcagtttgatctcagactgctgtgctatcaatcagcgagactccgtgggcataggacccttgagccaggtgcaggatataatctcgtggtgcgccgttttttaagccggtctgaaaagcgtaatattcgggttggagtgacccgattttccaggtgcgtccgtcacccctttctttgactcggaaagggaactccctgaccccttgcgcttcccaagtgaggcaatgctcgccctgcttcggctcgtgcacggtgcgcgcacccactgacctgcgcccactgtctggcactccctagtgagatgaacccggtacctcagacagaaatgcagaaatcacccgtcttctgcgtcgctcacgctgggagctgtagacctgagctgttcctattcggccatcttggctcctcc

SEQ ID NO: 12517 - DNA, 6050 bp, Homo sapiens
tttttttttttattaaaatatatatttttttatattattatactttaagttttagggtacatgtgcacattgtgcaggttagttacatatgtatacatgtgccatgctggtgcactgcccccactaactcgtcatctagcattaggtatatctcccagtgctatccctacctgctccccccacctcacaacagtccccagagtgtgatgttccccttcctgtgtccatgtgatctcattgttcaattcccacctatgagtgagaatatgcggtgtttggttttttgttcttgtgatagtttactgagaatgatgatttccagtttcatccatgtgcctacaaaggacatgaactcatcattttttatggctgcatagtattccatggtgtatatgtgccacattttcttaatccagtctatcattgttggacatttgggttggttccaagtctttgctattgtgaatagtgccgctataaacatacgtgtgcatgtctctttatagcagcatgatttatagtcatttgggtatatacccagtaatgggatggctgggtcaaatggtatttctagttctagatccctgaggaatcgccacactgacttccacaagggatgaactagtttacagtcccaccaacagtgtaaaagtgttcctatttctccacatcctctctggcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttctcgtaaatttgttgaagttctttgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctggggtttttatggttttaggtctaacgtttaagtctttaatccatcttgaattgatttttgtataaggtgtaaggaaggaatccagtttcagctttctacatatggccagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcattgcaggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggattgtagttctccttgaagaggtccttcacatcccttgtaagttggattcctaggtatttgattctctttgaagcaattgtgaatgggagttcactcataatttgtctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtcgtgagagagggcatccctgtcttgtgccagttttcaaagggaatgcttccagtttttgcccattcagtgtgatattggccgtgggtttgtcgtagatagctcttattattttgaaatacgtcccatcaatacctaatttattgagagtttttagcatgaagagttgttgaattttgtcaaaggccttttctgcatctattgagataatcatatggtttttgtctttggctctgtttatatgctggattacatttactgatttgcgtgtattgaaccagccttgcatcccagggatgaagcccacttgatcatgatggataagctttttgatgtgctgctggatttgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagtgtgtatgtgtcgaggaatttatccatttcttctagattttctagtttatttgcgtagaggtgtttgtagtattctctgatggtagtttgtatttctgtgggatcggtggtgatacccctttatcattttttattgcgtctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttacttgtgatgttagggtgtcaattttggatctttcctgctttctcttgtgggcatttagtgctataaatttccctctacacactgcttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgattgagattcttaatcctgagttctagtttgattgcactgaggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatataatggccttctttgtctcttttgatctttgttggtttaaagtctgttttgtcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggttattttgctcgttagttgatgcagtttcttcctagtctcgatggtctttacattttggcatgattttgcagcggctggtaccggttgttcgtttccatgtttagcgcttccttcaggagctcttttagggcaggcctggtggtgacaaaatctctcggcatttgcttgtctgtaaaggattttatttctccttcacttatgaagcttagtttggctggatatgaaattctgggttgaaaattcttttctttaagaatgttgaatattaccccccactctcttctggcttgtagggtttctgccgagagatctgctgttagtctgatgggcttccctttgagggtaacctgacctttctctctggctgcccttaacattttttccatcatttcaactttggtgaatctgacaattatgtgtcttggagttgctcttctcgaggagtatctttgtggcgttctctgtatttcctgaatttgaacgttggcctgccttgctagattggggaagttctcctggataatatcctgcagagtgttttccaacttggttccattctccccatcactttcaggtacaccaatgagacgtagatttggtcttttcacatagtcccatatctcttggaggctttgctcgtttctttttattcttttttctctaaccttcccttcttgcttcatttcattcatttcatcttccattactgataccctttcttccagttgatcgcattggctcctgaggcttctgcattcttcacgtagttctcgagccttggttttcagctccatcagctcctttaagcacttctctgtattggttattctagttatacattcttccaaatttttttcaaagttttcatcttctttgcctttggtttgaatgtcctcccgtagctcagagtaatttgatcgtctgaagtcttcttctttcagctcgtcaaagtcattctccttccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggggggtgcctcccagttaggctgctcgggggtcaggggtcagggacccacttgaggaggcagtctgcccgttctcagatctccagctgcgtgctgggagaactactgctctcttcaaagctgtcagacagggacatttaagtctgcagaggttactgctgtctttttgtctatgccctgcccccagaggtggagcctaaagaggcaggcaggcctccttgagctgtggcaggctccacccagttggaacttcccggctgctttgtttacctaatcaagccggggcaatggcgggcgcccctcccccagcctcgctgccgccttgcagtttgatctcagactgctgtgctagcaatcagcgagactccgtggggtaggaccctccgagccaggtgccggatataatctcatggtgcgcagttttttaagcccgtcggaaaagcgcagtattcgggtgggagcgacccgattttccaggtgccgtccgtcacccctttctttgactcggaaagggaactccctgaccccttgcacttcccgagtgaggcaatacctcgccctgctttggctcgcgcatggtgcgcgcacccactgacctgcgcccactgtctggcactccctagtgagatgaacccggtacctcagatggaaatgcagaaatcacccgtcttctgcgtcgctcacgctgggagctgcagaccggagctgttcctattcggccatcttggctcctccccga

SEQ ID NO: 12518 - DNA, 7175 bp, Homo sapiens
ctccacctcaaaaaaaaaaaaaaaaaaaaaaaaaaaaaaaaaaacaaaagaaatgatcatgtttgtaggtcaaaaaccattgaatatcagcaattacacataattcatccaagtattgactaattccttttgagaactgagttcacttcaactatcaaattactaattacggttcatttgtttttaaggtaacttaacaatgtatttattcttcttgcctttctttttaaaactaccatgcatctatacctctttatgaatcagcaaatgccagtttgtgagacatactaaaaagaaaactcccagactcatcaatgcaatccttgaattaccatgcaggaagatgatcctgcagctcttctgaatatattggtgtttttaaatatccataccctggtagctttgccaagaggtacctttgcctgttataccatgttagaaaattcatcctctagcacaaaaagaataaaaatacatataaacctaggcaaatgcttttaaaggctaaaacacggattgcagactcttaggggtaaatcccaccatttttctctctgacgctgtaatgatgttgttaggtgatttgtaaagacctaatattattctactttagcttatacaacagaaactccaaaaactattttgtatggattctttttatcttcactacggttctaggatgagagaaaaataatatcacttcatagaaggaaaaagtttagaaccaaatcagtttttgatgatgcaatcagtacaattcatttttaaatgttaagcctatacttgattcccttggtttcattgtgatctcattcttttgacttgactttgccgaataaacataatgtttagaggttgacaatggaaacgacattctgatttactctagtctattggatatttgtaacttgttaactcagttgtacaatacagtaggagtgaaaccaaactcatgggttgaccttcacatgggctagttattttcacataatcttttccacccatttaccattcataccaatccatcatttcagaaaaatgcctcacatcattagaaattggctgataccttcaagtatgagttttcactgttataaaaacaattgtgtatgtgtgtctgagtttgtgtatgtttagagtacaattggagagtaattacatagaaatgagacttacaaatattaggtaataaaatcactagatattcttcaatacatgtttttataagtatcaataaactggtattcatgaatataatgacctaaaacccaggaagtcacctttattttatttatttatttatttttattattatactttaagttttagggtacatgtgcacaatgtgcaggttaattacatacgtatacatgtgccatgctgctgcgctgcacccactaacttgtcatctagcattaggtatatctcccaatgctatccctcccctccaaccccacaacagtccccagagtgtgatgttccccttcctgtgtccatatgttctcattgttcagttcccacctatgagtgagaatatacggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcgtttctctgatggccagtgatgatgagtattttttcatgtgttttttggctgcataaatgtcttcttttgagaagtgtctgttcatgtccttcgcccacttcttgatggggttgtttgtttttttcttgtaaatttgtttgagttcattgtagattctggatattagccctttgtcagatgagtaggttgcgaaaattttctcccattttgtgggttgcctgttcactctgatggtagtttctttcgctgtgcagaagctctttagtttaattagatcccattcgtcaattttggcttttgttgccattgcttttggtgtttcagacatgaagtccttgcccatgcctatgtactgaatggtattgcctaggttttcttctagggtttttatggttttagctctaatgtgtaagtctttaatccatcttgaattaatttttgtataaggtgtaaggaagggatccagtttcagctttctccatatggctagccagttttcccagcaccatttattaaatagggaatccgttccccattgcttgtttttgtcaggtttgtcaaagatcagatagttgtagatatgcagcattgtttctgagggctctgttctgttccattggtctctatctctgttttggtgccagtaccatgctgttttggttactgtagccttgtagtatagtttgaagtcaggtagtgtgatgcctccagctttgttcttttggtttaggattgacttggctatgcgggctcttttttggttccatatgaactttaaagtagttttttccaattctgtgaagaaagtcattagtagcttgatggggatggcattgaatctataaattaccttgggcagtgtggccattttcaagatattgattcttcctacccatgagcatggaatgttcttccatttgtttgtatcctcttttatttccttgagcagtggtttgtagttctccttgaagaggtccttcacatcccttgtaagttggattcctaggtattttattctctttaaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctacctaattgccctggccagaacttccaacactgtgttgaataggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccaggctttggtatcaggatgatgctggcctcataacatgagttagggaggattccctctttttctattgattggaatagtttcagaaggaatggtaccagttcctccttgtacctccagtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctaaattttctagtttatttgcgtagaggtgtttgtagtaatctctgatggtagtttgtatttctgtgggatccgtggtgatatcccctttatcattttttattgcgtctatttgattcttctctcttttttctttattagtcttgctagcggtctatcaaatttgttgatcctttcaaaaaaccagctcctggattcattaatgttttgaagggttttttgtgtttctatttccttcagttctgctctatttttagttatttcttgccttctgctagcttttgaatgtatttgctcttacttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcagagaacatctttatttctgccttcatttcgttatgtacccagtagtcattcaggagcaggttgttcagtttctctgtagttgagtggttttgagtgagtttcttaatcctgagttctagtttgattgcactgtggtctgagagagagtttgttataatttctgttcctttacatttgctgaggagagctttacttccaattatgttgtcaattttggaataggtgtggtgtggtgctgaaaaaaatgtatattctgttgatttggggtggagagttctgtagatgtctatgaggtctgcttggtgcagagctgagttcaattcctgggtatccttgtcaactttctgtctcatcgatctgtctactgttgacagtggggtgttaaagtctcccattattggtgtgtgggagtctaagtttctttgtaggtcactcaggacttgctttatgaatctgggtgctcctgtattgggtgcgtatatatttagggcaattagctcttcttgttgaattgatccctttaccattatgtaatggccttttttgtctcttttgatctttgttggtttaaagtctgttttatcagagactaggattgcaacccctgcctttttttgttttccatttgcttggtagatcttcctccatccctttatttttgagcctatgtgtgtctctgcgtgtgagatgggtttcctgaatacagcacactgatgggtcttgactctttatccaatttgccagtctttgtcttttaattggagcatttagtccatttatatttaaagttaatatttttatgtgtgaatttgatcctgtcattatgatgttagctggttattttgctcgttagttgatgcagtttcttcctagtcttgatggtctttacattttggcatgattttgcagcggctgataccggttgttcctttccatgtttagtgcttccttcaggagctcttttaggtcagggctggtggtgacaaaatctgtcagcatttgcttgtctgtaaagtattttatttctccttcactcatgaagcttagtttggctggatatgaaatttctgggttgaaagttcttttctttaagaatgttgaatattggcccccactctcttctggcttgtagagtttctgccgagagatcatctgttagtctgatgggcttccctttgtgggtaacccgacctttctctctggctgcccttaacattttttccttcattccaactttggtgaatctgacaattatgtttcttggagttgctcttcttgaggagtatctttgtggtgttctctgtatttcctgaatctgaatgttggcctgcgttgctagattggggaagttctcctggataatatcctgcagagtgttttccatcttggttccattctccccgtcaccttcaggtacaccaatcagacatagatttggtcttttcacatagtcccatatttcttggaggcttagttttttttattcttttttctctaaacttcccgtctcacttcatttcattcatttcatcttccatcgctgataccctttcttccagttgatcgcatcagctcctgaggcttctgcattcttcccgtagttctcgagccttggctttcagctccgtcagctcctttaagcaattctctgtattggttattctagttatacattcgtctaaatttttttcaaagtttttaacttctttgcctttggtttgaatttcctcctgtagctcgtagtttgagcatctgaagccttctactctcaactcgtcaaagtcattctccatccagcttcgttccattgctggtgaggaactgcgttcctttggaggaggagaggtgctctgctttttagagtttccagtttttctgctctgttttttccccatctttgtggttttatctacttttggtctttgatgatggggatgtacagatgggtttttggtgtggatgtcctttccgtttgttagttttccttctaacagacaggactctcagctgcaggtctgttggagcttgctagaggtccactccagaccctgtttgcctgggtatcagcagcggtgtttgcagaacagcggtttttcgtgaaccgtaaattctgctgtctgatcgttcctctggaagttttgtctcagaggagtacccggccgtgtgaagtgtcagtctgcccctactggggggtgcctcctagttaggctgctcaggggtcagaggtcagggacccacttgaggaggcagtctgcctgttctcagatatccagctgcatgctgggagaaccactgctctcttcaaagctgccagacagggacatttcagtctgcagaggttactgctgtctttttgtttgtctgtgccctgcccccagaggtggagcctacagaggcaggcaggcctccttgagctgtgttgggctccacccagttcaagcttccccgctgctttatttacctaagcaagcctgggcaatggcgggcacccctcccccagcctctctgccgccttgctgtttgatctcagactgctgtgctagcaatcagcgagactccatgggcgtaggaccctctgagccaggtgcgggatataatctcctggtgcgccgttttttaagcccgttggaaaagcgcagtacttgggcaggagtgaccc

SEQ ID NO: 12519 - DNA, 11661 bp, Homo sapiens
ttttttcttttttttatttatttttattttattattattatactttaagttttagggtacatgtgcacaatgtgcaggttagttacatatgtatacatgtgccatgctggtgtgctgcacccattaactcatcatttagcattaggtatatctcctaatgctaaccctcccccttcccctgaccccacaacagtccccagagtgtgatgttccccttcctgtgtccatgtgttctcattgttcaattcccacctatgagtgagaacaagcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatccttgttggatatttcggttggttccaagtctttgctattgtgaatagtgctgcaataaacatacgtgtgcatgtgtctttatagcagcatgatttatagtcctttgggtatatacccagtaacgggatggccgggtcaaatggtatttctagttctagatccctgaggaatcgccacactgacttccacaatggttgaactagtttacagtcccaacaacagtgtaaaagtgttcctatttctccacatcctctccagcacctgttgtttcctgactttttaatgattgccattctaactggtgtgagatgatatctcatagtggttttgatttgcatttctctgattgccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcattctgatggtagtttcttttgctgtgcagaagctctttaatttaattagatcccatttgtcaattttggcttttgttgccattgcttttggtgttttagacatgaagtcctcgcccatgcctatgtcctgaatggtaatgcctaggttttcttctagggtttttctggttttaggtctaatgtttaagtctttaacccatcttgaattaattttgtataaggtgtaaggaagggatccagtttcagctttctacatatggctagccagttttcccagcaccatttattaaatagggaatcctttccccattgcttgtttttctcaggtttgtcaaagatcagatagttgcagatatgtggcgttatttctgagggctctgttctgttccattgatctatatctctgttttggtaccagtaccatgctgttttggttactatagccttgtagtatagtttgaagtcaggtagtgtgatgcctccagctttgttcttttgacttaggattgacttggcgatgggggctcttttttggttccatatgaactttaaagtagttttttccaattctttgaagaaagtcattggtagcttgatggggatggcattgaatctataaattaccttgggcagtatggccattttcatgatgttgattcttcctacacatgatcatggaatgttcttccatatatttgtatcctcttttatttcattgagcagtggtttgtagttttccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggataatttgacttcctcttttcccagttgaataccctttatttcctcctcctgcctgaatgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggttttttctgaatctattgagataatcatgtggtttttgtctttggttctgtttatatgctggattacatttattgatatgcgtatattgaaccagccttccatcccagggatgaagcccacttgatcatggtggataagctttttgatgtgctgctggattcggtttgccagtattttactgaggatttttgcatcaatgttcctcaaggatattggtctaaaattttcttttttggttgtgtctctgcctggctttggtatcaggatgatgctggcttcataaaatgagttagggaggattccttctttttctattgattggaatagtttcagaaggaatggtaccagttcctccttgtacctctggtagaattcggctgtgaatccatctggtcctggactctttttcgtcggtaagctattgattattgccacaatttcagagcctgttattggtctattcagagattcaacttcttcctggtttagtcttgggagggtgtatgtgttgaggaatttatccatttcttctagattttctagtttatttgtgtagaggtgtttgtagtattctctgatggtagtttgtatttctgtgggatcggtggtgatatcccctttatcattttttattgcatctatttgattcttctctcttttcttctttattagtcttgctagtagtctatcaattttgttgatcttttcaaaaaaccagctcctggattcattattttttgaagggttttttgtgtctctatttcctttagttctgctctgagtttagttgtttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttttcgttggtttcaaagaacatctttatttctgccttcatttccttatgtacccagtagtcatccaggagcaggttgttcagtttccatgtagctgagcagttttgagtgagattcttaatcctgagttctagtttgattgcactgtggtctgagagacagtttgttataatttctgttctttcacatttgctgaggagagctttacttccagctatgtggtcaattttggaataggtgtggtgtggtgctgaaaaaaatgtatattctgttgatttggggtggagagttctgtagatgtctgttaggtctgcttggtgcagagctgagttcaattcctggatatccttgttaactttctgtctcgttgatctgtctaatgttgacagtggggtgttaaagtctcccattattattgagtgggagtctaagtctctttgtaggtcactcaggacttgctttatgaatctgggtgctcctgtattgggtgcatatatatttaggatagttagctcttcttgttgaagtgatccctttaccattatgtaatggccttctttgtctcttttgatctttgttggtttaaagtctgttttgtcagagactaggattgcaacccctgcctttttttgttttccatttgcttggtagatcttcctccatccttttttttttttttttttttctttcaattcattttaattattaatagacaacaggaaaccaattgaggcttccaataagttactgtgtattaaaccatggttgaaaacttcaagataagatgggattcttagaagcagcgaaataaaaaacagattatgttagattacactttatattatctgctgtgacagttacagaaatattagtaaaaggtcaatcaaatcaagtcttgttgtggttgttaaaatgaataaacttataatagatgtagtaagaaatttttatatctagggaaacatacgaattaagtttaatatacaccgtcatcattaaacatctatgaaatatgtttttgaattacaataataagagccatgtacattcttaaaatattttggacaaaggaatagtacaatagtaaagttgcttttccctcttgggtaatcactatgtagaagcaatatgatgtgttccagtgaatcctctaaatttccagaaggaacgaagtcatttacctcttgtcttcattaggtagcagcacattatagcatcatgaacactagggaccaataatcaatggctcttgtcagtatagtaactcctttctttttctgccagtctgccagcatgaagatcccaaaatgaccatgcagctgctcagtttggatttggtggaacctttaacaaggatgctggtagaatagctttccccacccctactccaggaactgggacctttagtccagaaaagcctaaagttgtagtaatgaaatcactaattctcccacagataactgcaaattataattagaaatgctaatcctaatttcaccatttcagtcccagactcatgttttctaactgctaagtacacagtcttatataatggccattagttaaataatatactttaccttgaagccttgaaggacaatgtccccatctcagagatgtcacttccaagttggtacttagctctgccctcaggagaccacatgatgtatggtagaaacagtacattccttggttatttatcattgtcacccctccttctgaaagtgtgacccttggtcctaggagatgtttttcaagatttatgaacctttgagtggtggtgctttgcaaggtgctgtgggaaagacagagagttctatgccaagaataattcaagtcggggcaaatcactactccttttagtaggtaagtggtctgatgttttcaacttgcctccaagtggctagttggtctctttggtggatggtaccatcatccgtcaagtgctcaacattgatctctgcttttgacagatctgatattcagtagcagcagtacatagtactgattagcacgagggagcccatgctatttggcccatgtgcatttttattatgacaccatagcttttttatttttgagttccgtgctcaggcactggagtgtatgagtacagaggctgactgagcttcccttgatgagtcatctagaaccctttttctctaatcttccaatattgctagttgctcttaccaaccagcaaagtcatttaccactgtccgctatacattattccttgaggaaagtgtccaggtgtcctgttttgttttttttttttttttttttcttttttttttttttttattatactctaagttttagggtacatgtgcacattgtgcaggttagttacatatgtatacatgtgccatgctggtgcgctgcatccactaatgtgtctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccattttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatctgggtatatacccagtaatgggatggctgggtcaaatggtatttctagttctagatccctgaggaatcgccacactgacttccacaatggatgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcgaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtaagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgagtttagttgtttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttttcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcaatttcttcctagcctcgacggtctttacaatttggcatgattttgctgtggctggtaccggttgctcccttccatgtttagtgcctccttcaggagctcttttagggcaggcctggtggtgacaaaatctctcagcatttgcttctctgtaaaggattttatttctccttcacttatgaagcttagtttggttggatatgaaattctgggttgaaaactcttttctataagaatgttgaatattggcccccactctcttctggcttgtagagtttctgctgagagatccactgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttgtttccattctccccatcactttcaggtacaccaatcagacgtagatttggtcttttcacataatcccatatttcttgtaggctttgttcatttctttttattcttttttctctaaacttcccttctcgcttcatttcattcatttcagcttccatcactgataccctttcttccagttgatcgcgtcggctcctgaggcttctgcattcttcacgtagttctcgagccttggctttcagctccatcagctcctttaagcacttctctgtattggttattctcgttatacattggtctaaatttttttcaaagtttttaacttctttgcctttggtttgaatttcctcctgtagctcagagtagtttgatcatctgaagccttcttctctcaacttgtcaaagtcattctccatccagctgtgttccgttgctggtgaggagttgcattcctttggaggaggagaggcactctgctttttagagtttccagtttttctgctctgttttttccccatctttgtggtttttatctacttttggtctttgatgatggtgatgtacagatgggtttttggtgtggatgtcctttctgtttgttagttttccttctaacacacaggaccctcagctgcagctctgttggagtttgctagaggtccactccagaccctggttgcctgggtaacagcagcggtggctgcagaacagcggattttcatgaaccgcgaatgctgctgtctgatcgttcctctggaagttttgtctcagaggagtacccagccgtgtgaggtgtcagtctgcccctactggggggtccctcccagttacactgctcgggggtcaggggtcagggacccacttgaggaggcagtctgcccattctcagatctccagctgtgtgctgggagaaccactgctttcttcaaagctgtcagacagggacatttaagtctgaggaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcggccgccccttccccagcctcgctgccaccttgcagtttgatctcagactgctgtgccagcaatcagtgagactctgtgggcgtaggaccctccgagccatgtgcgggatataatctcctggtgtgccgttttttaagcccgttggaaaagcacagtattcgggtgggagtgacccgattttccaggtgccgtctgtcacccctttctttgactaggaaagggaactccctgaccccttgtgcttcccaagtgaggcaatgcctcaccctgcttcggcttgtgcacggtgtgctgcacccactgtcccgcgcccactgtctggcactcccttgtgagatgaacacggtacctcagatggaaatgcagaaatcacccgtcttctgcgtcgctcatgctgggagctatggaccggagctgttcctattcggccatcttgactgccc

SEQ ID NO: 12520 - DNA, 36722 bp, Homo sapiens
ttttctttatatcttctttttttttaattatactttaagttttagggtacatgtgcacattgtgcaggttagttacatatgtacacatgtgccatgctggtgcgctgcacccactaacttgtcatctagcattaggtatatctcccagtgctatccctccccccgccccccaccccacaacagtccccagagcgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcgcatgatttatagtcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcttgtccttcgcccactttttgatggggttgtttgtttttttcttgtaaatttgttgagttaattgtagattctggatattagccctttgtcagatgagtaggttgcgaaaattttctcccattttgtaggttgcctgttcactctgattgtagtttcttttgctgtacagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggtttaggattgacttggcgatgtgggctcttttttggttccatatgaactttaaagtagttttttccaatctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcgcatcccttgtaagttggattcctaggtattttattctctttgaagcaattgtgaatgggagttcactcatgatttggctctctgtttgtctgttgttggtgtataagaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgcgctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaggatgaaaggttgttgaattttgtcaaaggccttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcggtttgccagtattttattgaggatttttgcatcaatgttcgtcaaggttattggtctaaaattctcttttttggttgtgtctctgcccggctttggtatcagaatgatgctggcctcataaaatgagttagggaggattccctctttttctattgattggaatagtttcagaaggaatggtaccagttcctccttgtaccttgtggatccttgtgaatccatctggtcctggactctttttggttggtaaactattgattattgccacaatttcagctcctgttattggtctattcagagattcaacttcttcctggtttagtcttgggagagtgtatgtgtcgaggaatttatcgatttcttctagattttctagtttatttgcgtagaggtgtttgtagtattctctgatgatagtttgtatttctctgggatcagtggtgatatcccctttatcattttttattgtgtctatttgattcttctctctttttttctttattagtcttgctagcggtctatcaattttgttgatcctttcaaaaaaccagatcctggattcattgattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatgtagtgctataaattttcctctacacactactttgaatgcatcccagagattctggtatgttgtgtctttgttctcgtcggtttcaaagaacatctttatttctgccttcatttcgttatgtacccagtagtcattcaggagcaggttgttcaatttccatgtagttgagtggttttgagtgagattcttaatcctgagttctagtttgattgcactgtggtctgagagatagtttgttataatttctgttcttttacatttgctgaggagagctttacttcgaagtatgtggtcaattttggaataggtgtggtgtggtgctgaaaaaaaagtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcctgttgaactgatccctttaccattatgtaatggccttctttgtctcttttgatctttgttggtttaaagtctgttttatcagagactaggattgcaacccctgcctttttttgttttcctttggcttggtagatcttcccccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatatagttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagttcttttagggcaggcctggtggtgacaaaatctctcagcatttgcttgtctgtaaagtattttatttctccttctcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcattttaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaagttggttccattctccccatcactttcaggtacaccaatcagacgtagatttggtcttttcacatagtcccatatttcttggaggctttgctgatttctttttattcttttttctctaaactttccttctcgcttgatttcattcatttcatcttccattgctgataccctttcttccagttgatcacatcggctcctgaggcttctgcattcttcacgtagttcttgagccttggttttcagctccatcagctcctttaagcacttctctgtattggttattctagttatacattcttctaaatttttttcaaagttttcaacctctttgcctttggtttgaatgtcctcccgtagctcagagtaatttgatcgtttgaagccttcttctctcagctcgtcaaagtcattctccatccagctttgttccgttgctggtgaggaactgcgttcctttggaggaggagaggtgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttgcaataccctgccgtgtgaggtgtcagtgtgctcctgctgggggtgcctcccagttaggctgctcgggggtcaggggtcagaggcccacttgaggaggaagtctgcccgttctcagatctccagctgcatgctgggagaaccactgctctcttccaagctgtcagacagggacatttaagtctgcagaggttactgctgtctttttgtttgtctgtgccctgcccccagaggtggagcctacagaggcaggcaggcctccttgagctgtggcgggctccacccagttcgagcttcccggctgctttgtttacctaagcaagcctgggcaatggcgggcgcccctcccccagcctcgctgccgccttgcagtgtgatctcagactgctgtgctagcaatcagcgagacaccgtgggcgtaggaccctctgagccaggtgtgggatataatcttgtggtgcgccgtttttaaagccggtctgaaaagcgcaatattcgggtgggagtgacccgattttccaggtgagtccgtcacccctctctttgactcggaaagggaactccctgaccccttgcgcttcccaggtgaggcaatgcctcaccctgctttggcttgcgcacggtgcacgcacccactggcctgcgcccactgtctggcacaccctagtgagatgaaccagatacctcagacggaaatgcagaaatcacccatcttctgcgtcactcacgctgggagctgtagaccggagctgttcctatttggccatcttcggttcttgatttctctttatatcttctattcctttgctaaggttttgtagtttttcttttgtttcaaacgtgttcttaattgctcattgaagaatttttatgatgcatgtttaaaaatatttgtcaaataattccaacatcagtgccatctcagttggtatctgttgattgtcttttctcatttactcaagattttcctggttcttgatatgatgagtgactgagtaattttcagctatatcctggaaattttgggtgttattttatgagactcttatttaaacttcctgttttagctggtctatgaatttgctagtgctgccataacaaaacaacacaacctgggtgctatggtattctactttattttctcacagttctggaggctagaagtccaagatcatggtgctggcaggggtggttttcactgaggtctctccttggcttgcagatgactgctttcttgctgccttttcacgtggtagtccctctgtatatgtgtacccctgatgtctatgtgtgtccataatatctttttcttatgaagacacgagtcagattggatagaggcacacccaaatagcttcattgtcacctaattacctcttaaaaagccctattgccaaatatagtcacgttctgagtttctgggggttagggctttaacatatgaattaagagagccacaattcagttcataaagagctgtcttcttctaacactgcactggtaaaggaagtagaaatgcctccttgttactggaggtggagaagtgcatgtttcccacccagcctccactgacacccttatgggggtatcttatttctactgctgggcaggagtagaagttaaggctcccctctaggcctctgctgacaccactctgatgagaggggacacctggttactgtttctcccatggcctccactgactttcatcagggaggtgctccctattaccactgatggggaggaaagtcctagttccctacccaaccttctctgatgccaccctagcagaagactcgggcacatgttacagcacatggtgattgtagaagtctaggctcctggttggtctttgcagatggaatggaggtgggccccatcttgttttcatggtgtcttcctagaatagggcagttattgtctaaacattttttgtcttgttgttcctttcttggtctaggctagagaaataatgcatttcttggagcttttttgtctatactctgtggtgtttttgtcttgctaatttctctagtttctccagctcccagcctaggatatagtgggcaaaaaagagggggggaaaaaaaaagccagggaactaaccattgtgccattccttgaatcccaaggaccccagccagtctgccttcctacagtcacattttagagttttcttttgttttacatatgatacccagcccttctagtactttaacagttctattttttaatgtttaatccatctggaagctattgtagttcatggtgctgctgaaccactactttgacaaatgtcaaatcaacttatccaggaccataaaaaacccttttacatgttggtttcaattgaacccttttgcatgttggtttcaattgcacagtattttgtagatctgtttaaagagtaatcctatttttattttaaagagtaaccctgtttttatacaagagaatactgagtctaagcactgaatatcagtgttgtacatgcagtatctcatttagtcttctcaataaccctgtgcaataacattttcattttgctagcaagaacatttataaccttgcctatggccacgtattaattagcaactgagttggggtcataatttaagtgttctaacttctactcaatttttctttccttatgtgtacagaagccaaaacactttttctcctaggattaaagattgtttagaatctgctaaaattagacaaacaaagcactgttactgtatatctatcaccagaaacacggcaatgatttagagagatatgttttcaatatccttctttgtaatatatttgttacagtgagatatttttaataacttgccagctcccgtcccatgggaggaaaaaaacagcaagcatgaacaactcacatcatggaaataaaaacaaagaggcattttaaataacagcccggatatcattaaaatgtttttcctttattacatagcattataattgccttaaatggttatggttcaaaggagaagaaaaatatgcccctttcttgctatatgaagtcccccactcaacttccctttgagaatcacctttctaaggttaagtgaatggaacctaaaggagagattagatgaagaaaagaatcaaagtacttctgaaatagtgcaaaccatcatttccatgcatgctggaggaggagcaatttggaaatgggggaacatgggctgaatatcccacaacccatgacagtagttgaaataattttcaaagaaaatttaacaatgacacaacaatgtagctagagtctgaagagaacagaaaggcagaagaaggggtcttatgagctgtaagacgtggcattcgatttgaatagctggcaaagactcaggctcttggcctggaattcacccatggctagaccaaaaaggaatcttccatttaggtggttctcacaggtctcagagatactcagagggtgctcagcatccttggaatctcccagtgcagcctgacaggagtctcaggcctacggcctctcatgtagaggaaacaattatgttctgggaatgtattagttctgctatctgttctgttctgttctgctgtgtaacaaacaatgtactccaaaatttaatggcttaaaacaacagctcttattacctcacagaaactgcaatcaaggtatcatcctgggagtgcagcagatttcaagcctcagtggggaaagatctgtcccctagtacattcacatggtttggccgcattcagttcctggtgggctgttgcacggagaacctcagttacacagttgctttctgttcctcactatgtgggtctctccataggacagcttacagcagtggcagcttgcttcatcagagccagcaagagaaggcaagcacaaaagtaggcaagagtcttttgtaacctaattttgacagtggaattccatcacttttgctgtattctgtatggtagaggcaagtcactaaggtctagtctatactccaggggaagcttgcaaggggcagggatcactggaaactatgtctgaaactgcctccacagggagtggaatattagttaatagtacttgactaaaataattagactcatcaagacagtgcctgtgaaggacatagggatcttcaggtacaggaaacatctaaaatggaattgctaagctggcagcaattccagagcggaggctctgctctctcttacgggctgcatgatctcttagggcatctctgcatatctggtctcttctgctattctcagccaattggctatttttgtttatggatagtcttgtgcatggtccattgaggcctctgtgctgggctgctgcttactctatttgccttctagattcatttccatccttctccatcctcatttgccccagaattttgtaccactgggctccttttccttctggcttcggattggctttgtctgttctggctaaagatggaggaaataaaaagagcaaggtcttgtttcttaactcccttcttgtccctcacctgcagatcacagctcctgccacttggctctctctttgctgttctacctgcattctagtgactgcttctctcttgctgtttcaggccttttggtggtgagagtgtctgccatgactagacctggggtatcacatgattccttgtagttttcccacccccactcacacctttacaaatagcctatttttaaaactgtcctctaatacatttgagcatgccatctgttctgcagggatcctgattgaggtagccttctttgaccctgaagtctacctcttgacattagggggtcagtttattttacctatctcagttgcttgatttcacttttagatttccaagagaggaatctaattattcaagaaaaatttttgattgctcatgccatttctgggtcaaggtccattcctattctaattaactgtggttactggctgagatgagatgggggtccccggtgtcttgggaagtgtaggttgcctcagaaatgcatatgtgctagaaaacacattactgtcatctctagagtatgatgagggggctgtaaaattcccatctatataaaaccttgcttttggctgggtgcggtggctcacacctgtaatcccagcactttgggaggccgaggcgggaggatcatgaggtcaagagatggaaaccatcctggccaacatggtgaaaccctgcctctactaaaaatacaaaaattagctgggtgtggaggcacgtgcttatagtcccagctacctgggaggctgaggcaggagaatcacttgaacccgagaggaagaggttgcagtgagctgagatcgcgccacagtactccagcctggcgacagagtgagactgcgtttaaaaaaaaaaaaaaagcttgctttcagtggcatccctgatttgagcccaggaacccagtctatcctttctgcctgcagacaaatggacagtgtagtccttgtacagtctctgctcctctgatcctgctcaggaatcaagggcagtagctgtgcaggtgtgctatctttatctacggtgaggaaagggagagtgtgactggggatacaccttacttggaattacgcaattatcaaatggaagaattaggattcaagaccaggtgaacctgttgttagtatttaacttatcagaatatttctcatatttttttacactgatggtctacttctggaaaaaattatcaatgcttattccctccagggtgtttttaggttagcatggaataacacttaattgtgaatagatgatgctacactgttctaaatttaacagaaaaggtggtttcctgggacttttgacatctcaccaggtggcaagtagactgcctattttggggtttgctcttgtcagataagtaaagagagggccatctctttgctatggtttgaatatttgtggccctccgaaaattcatgtgttgaaacttaaccaccaatgtggtgatattatgaggtgacacttttgagaggggattaggatgagggctgagccctcatgaatgggattagtgcccttacaaatgaggccccaacgagctgcgttattccttccaccatgtgagaatatggtgagaagatgccttctgtgaaccaggaagtgagctctcaccagaaacagaatgtgctgctgcctcaatcttggaattcctagccttcaaaactgtgagaaataaatttccgttatttataatatctattttatagtattttgttatagcaacctgaacagactaagacaattggtaccaagaagaggaagaaataccacttctacaaaatacctaaggggaaattttaggtatttgttacagtgctgctaaaatgtggaagcagcttggaactgataataggcagaggcaggaagggtttctaagtgaatactagagaagcctacgttggtgtgaaggaaccttaaagggtgattcgattgaggactcagaagaagagtactgtagtgacagcctaaatgttcctagcaaatgcgtaagtggttgtgaacagaatgtttgtagaaatatggacagtgaaggccattctgctgatgtctcaagtggaacggaggaacatgtcattgaaaacttgaggaaaggggatccttgttataaagtggcaacaggtttggctgagtagtgtttgtcctagaattctgtctaaagtagaatgtgtgagcaactggatatttagctggagctatttctaagcagagtgtggaagcttagtttctcttgactccttatagtaaatgcaagaagagagaattgatttaatgatagaattattaatcaaaagggaagcagaatataaatatttgggaaattcttattcatattgaaaggaatgagaaagcatgtctgggagagaaaaccgagggtttgaaaaagtgaccacttgataagattagcatggatgagccatctgagcagagccaggacttattgtacaagataataaaagagtaacctggaaggcatttcagacatcatgttgctgctcctcccatcataggcccagagtttcagggcctgggagaaaaaacaatttcaaaggagggggcatgggcacctgcaggatcttagcacttgctaccaggcactgcctcaaggctctgttctccacacttcattgccaagcttcttggttgcccccggtgcagctccagcagaccctggtatggtgtgcactgcacccagcaaagatgtagaggcatgactgccttcacccagatttcaaaggatgccctgctgagctgtggagcccaagcagagatttgctgtgagggcgagatcactgtagagagaccccaccagggcaattcctagtgcagccacgagggtagagccacacactgtgacctcagacgcttagagccactggtgcatgattcccactgggggtgggaggaccacaggcacgtgactcaggcacagaaccccaaggaggtggggctgctgcagagagccaccatgggggtgtggctgctcaaagccatggggcaggaccgctgccacagagagttggaaggtgggacctcacctcagtggacctagaaggcagtaaagcatccagtcaatgaaggctattcttgagctttaaggttttagacttgttcaaaacctgttactgtctttcttttctgtgtatttcttttgaaatgtgaatgtctaccctatgcttagagcctcactatattttagaagcacataacatttgatttcacaggttcgcagctggggagagaaatttgcctcaggatgaatcataccttgagtctcacccatatctaatatagatgaaatttagctaagactctggattttagacttttgagttgatgctggaacaaactaagacgttagtgactgggatagaatgcatgtatttcacatgcgagaaggatatggattttcggggaccaggggcaaaatgccatggtctgaatgtttgtgtcccacaccccttcccacccttcctaccccccaccctaattcatatgttgaaatctaagcatccgtgtgatgatattaggaggtagggcttttgggaggcgattagttcatgagggtggagccctcatgaatagaattagtgcccttataaaaggggctccagagaaaaagctggcttgtaccttctaccatatgaggacacatggtgagaagttgccattctatgaaccaggacctgaatacctaccagacaacaaatctgcctatgccttaatctcagaattccaagcctctagacttgtgagaaatacatttctgtttctctatgccacccagtttatggcattttgctatagcagcccaaatgaactgagtcactcttttacctgtgaattagtggagaaggtttggcaccaaatgttctgagtcctgaggatgggatgaaagataaacttcaagcatcttttatctggaaagccctccctcattctctgagttggatgctattctcttccactccccaacagcatcaactaatgtctccaatatagcctgtgtcattctccagtctaattaataaccttgtattatatcagaagctccatgaggcctggtattacgttttgctcatttctgtaacaccaagacaccaagtggagtctagcagatatgtttaatgaatgagagagttcacctattcaggaattgagcccccaggggctctctacaatcttatacctcgaggctgctccaatagagtggtcttgaacatcccaggcaagaaagcttccaactgtgacttcacagtggttaagtcacttgaaaatttgaccaaataaaattaacttttcaaattttttaataaaagaagaaagaataaatgattttcctaaggtactaaagacagaagttgtataggtttcattaagtaacatggcaaacactatattgtgcttggacagtttcaaagatgggcaagttatatggtttggctctgtggccccatccaaatctcatctcaaattgtaatctccgggtgttgaggtagggccctgaggcgaggtgacgaaatcatgggggcggtttcccccatgctgttctcaggagagtgaatgagttctcatgagatctgatggtttcaaggtatatggtggttcccctttctctctgtctctctggcctgccaccatgtgaggaaggtccttgctttccctttgccttccaccatgattgtaagtttcctgaggcctccccagccatatggaactgtgagtcaattaagtctctttgctttataaattacccagtcttaagtagttctttatagcagtgtgaaaacagaccaatacagcaagccacattttgtaagcctcacactgtcatcattacataaagagaattgtgaaaagactaagtagaaagacagaatgtaagaatttaaaagagcatgtagtatggagttacagacctcaattagactttaacagctatgtgtgtttgggcaagtagcttaactttgagcctgtttttctagtgtaatgggaataatgttatctaatctcactggaattattgatttaaattgtatgcgaaacacttagcatagggccagcacatggtattcctcaacaattggtaaatattaatgtttttaattatataccatcaaccatctacttaagccagatagtctaaatatataaatgttaaaatgacagcaaatgatcctgccccgtgtccaccaatgacaagtgagtttcctcctccaaggaaagctgctggaaacatcagaaccctccatcccccaggcaagaaggtaattgttggaggtttatcttgtaagaggtattccttctgccaccactagagcagacttcatcttctttctctgggtgtctcataggaatttctctcagttactgcagaactctgttatgccacttcaacaaaaggctttcccaataaacatacatttccctttgatgtgactcatgacttctctgtgcctacaagatgttgcagcttcaaaaggcatctctgtgtctgttgcttgagtgtttattatctcaaggggccctcagatgatttataaactaggttatatttaagagaaaaaaagatatttgtaaaatccacatttggaatgctacaggacatctataggatattttaagttttaggagaaatcagaaaccagataactccagaaaagaactgaataagcctgtcaatctcacctgtctcccataacgtcacagtaagaaaccagtccagagataattctattaggttggtgcaaaataactgtgatttgcggccaggaatcttaaatcattgtaactaggctcaaacacatccttattaatcaaaataggaattattacaatcaacacatttttgccaacaagaaataagtttgtttattcctgtggcataaaaatccatgctttgggattcgacaaactcttggaaagcattttctgcatcctgctggttgtagaagtgttttccctacaagagttgtcaagatgctggaagaagtggtagtcagttggtgagaggtcaggtgaatatggcgggtgaggcaaaactttatagcccaatttgttccacttttgaagcattggttgtgccatgtgtggtcgcgtgttgtgcagaattgggccctttctgttgatcaatgccagctgcaggtgttgcagtttttggtgcatctcattgatttgctgagcatacttctcagatggactggtttcactgggaatcagaaagctgtagtggatcagacctgcagcagaccaccaaacagtgaccatgacctttttttggtgcaagtttggctttggaaagtgctttggagcttcttctcagtccaaccactaagctgatcattgccggttgtcatataaaatccatttttcattgcatgtcacaatccaatcaagaaatgatttcttgttgtcgtgtagaataagagaagatgacactttaaaacgacaatttttaaaatttttgctcagctcctgaggcactgacctattgagctttttcacctttccaatttgcttcaaatgctgaaagactgtagaacggttgacgttgagttcttctgccacttctctcatagctgtaagaggatcaacttcgatgattgctctcagttggtcattgtcaacttccaatggccgacaactatgctccttatcttcaaggctcttttctcctttgcaaaacttcttgaaccactactgcactgtacattcattagcagtttctgggccaaatgtgttgctgatgttgcgagttgtctccactgctttgcgacccattttgaactcgaataagaaaattgcctgaatttgctttttgtctaacatcgtttccatagtctaaaataaacataaaataaacagcaagtaatgtcatcagacaaaaaaaaaataaagtgagaaatgcttactaaaatgatgtatagaagaactatacactaaccatatttatttaagaatgtactccaatatcaaacggcagattttaacaatgcaaaaactacaattacttttgcactcacctaatatgttcttttatctggatttgtatgtattttctgggataaagagtaacagacagactagtatattagtgacacaatttactagctacataatcttggacaaattacttgacctctctgaatcttacttttcttatgtgtaaaatgggtatttggaaacatgctatatttgaggttttcttcagaaagggaagatacactcttcaaagccagtcctcctcttttcctttgcagtgctggactattattgtactttatcaaatatttcaacttacagagatggccggggctgggcagagagctgtggatgtataaagaagaagtaggctttgctacagtgagccaggtcattgtctaagactttgatgttaacttataaaaacttttaagaaaaactataatttcaaaattttctgaagttatttggggaaaaaaatgtctacaatcttcaaaaacaagcttagatttcatcaggcatgtaggcttcattcccgtattattatttagataataactagacaaacatccctggatgttaaataatttgaaaaatctcaggtgacatggatacaccaaaaagaaaaattaagtgatattaaaaaataaatgactggaattttgccccatgaaggacagaatgttgggaacagaccaatgtttcttctaaaacaagtaataaatcaagatgaaatgtaagaataattggcttaaaggcaatggagatctgctgaagccatgaggacctgaaggtctgaggctttggagagggcagaaccacagggaggtgagctgaaaatgcgctgctgcttttttcctgtggccatttgactgattatgggcaagaacaagaggctgagaatgtacccttgctcaagtaaagaaacatctttaggtgacagaaaaatggacagggctttgtgtggtcttaaaggtttggaatgaaaaattggagacctgggaacctcaaacatcatccagcttccctctcaagaagtctgttaaattctgaagctctgtgaggtagcaggctaaaaatctaagaagaaaacatttgagcagaattttctgcagtcttgtgctgagaaaacaaagagtagagtttaaggcctactagtggaacacaccaggccttcagttaatagcctcgaagagctatatggtagaaacaatggcgaatcaaaagtagactgagtttataaaacttgcaaaaatagctgatattcatctcaatgcctgattggattacagggatcagcctcttcctttctcttcctagaaaagggaagaataaacttttttgggagctgtatgtttaaaagatagaagaaaagtttgataattttagcaaagaactgaaaattataaaaaattggaaataaaaatattaaaaattaaaatattctggaatttaaggaattcagtatctgaaattacaaatagagagaagcagataggcgtgacaggaaacaggattagtgaactagagtaggtcattagaaaatattcaaattaaagcatcaaaagaaaagaaaatacagtcatgtgtcaattaatgatggggaaatgttgtaagaatgttctgagaacgatggagatccattctaagaaatgcatcattacaatggtatttgtatatctttacatatctaagcatagaaaagttccagtaaaaatgtggtataaaatattttttaaaagggtacacctgtgtagggcacttgccatgaatggcacttaaaggactggaagtttctctgggtgagtcagtgagtggtgagttactgtgaaggcctaggacattactgtacactgctgcagagtataacactgtacatttaggctacattaaatttattttaaaatttctcttttttcaatattaagttaactttagtttaccataaattttttgttccataaacttttatattttttaaaactgcttgactcttttataataatgcttagcttaaaacacaaacacattgtacagctgtacaaaaatattttctttatttctatcattataagcatttttctatttttaaaattatttgttatttttaacttttagaaattttttgtgaaaaatgaagacagaaacacacacattggcctaggccttcacagggtgaggaccctcaatatcactgtcttccacctccacatcttgtcccactggaaaacctgcaggggcaattacacgcatgaagctgtcatctcctgtgataatgacgccattttctggacacttcctgaaggaccttccccaggcttttcttgaggaggtgtccatggtggtgtgcctggtttcttttttccatcatagattttttttccatcatagatttctgtgactaattcagagagagggagacaggagttgacactgactaggtgtgagggggtttgctagggctctaattcactgcaagcaggcttgagtgaggaaaggcctctgggaaattctctgaaatatttatggcttgattacgtatatgttatgggatggcatggttactgaacttccccccatggttggggtttaagcctttttatttggggattaacaccgcttggagagcaggggaatttggaggcctgctggctgtgcatgtaatgtgttcctgcacatctgcgccctcagtaagttctcatattgccattagagcatccatgaaaagaatccagtgtttgtgagtcaatgtcgcttccatccctcctccaatctcagcagattgaatgatgtcaagttaggaggggttatctgagatcaaatgtggaggcttaattatcacagacaaaaaccactaatgaggaaacaacattatctttcacagatgaagctgttttgatggaaactaatttatggcaagtgttctaatctctaggcttcatcacgaagaggctctgtcctcaccgctttctccttccccctccccatcacttctctgctctcattaactcagtctcacaggaaatcaaagagagaagacagtgctttccacaccttttacagaaaaggaaatggaagcaatgaggttgccagaattgcttccaggcaagattgccaaaaacaatgtcttctttgggagcccctcacttttctttttggctcctgttccctcatacctatacctctctctctcttgctctgcgactccccgaccctttccttctctctctctctcaatctctctctttttctcccctcattgttgtctgctacctcttctgccttgacctaatcctcttccatgttccttatttataaataagggtctttggggagggtcttaccagggctggggtgctggcagtgtaggttcagagcagaggttttcctgcccacatctcgggaaaggatgagtagccttcagagggtgggcagggggagaggttataaggtttaggaatcaaagctacttgtcagcaagacatccagggggacttccaggtgccacagggggagttagtaaacaccaggaagtgacacgacagctggaaatatccctcccacctctgcttttatgttgcttcattctctgctgtttccctgcagtgattcacagtaaacccaccaaaccctgcagcacaggtgggactggccaaggccaccccgttgcatgcatgtccagctctggagggaaccttcagggatcaactgaccagtggcccctatgaggcaggaagaaggaggctgggaatgtccggtctcagggggctgtggcaaaaaaggaaggagagaacttagtcagtctagggccaggcattttgtctgttctgcctgaccgatgcctccagaacacaggccaggtctttccctttctgtatcctcattgccttcacatattttgacatacatagcagggactcaacgcagagtccagtgaaagaataaagaaatgaatgaaggaaggatgcatctcttccttaaaatgatgtatgccaatgttttacctaatccatgtcactctttagcagtttgggccccagggtgtcaccacgggggctccatatccccaccctttatgctcactgtgttgggaactgtcagaaccagggcaaccactgctgtgtgtgtgttcccagaagcagtgggccaggctgagggcaggagtccagcacgaccaggagcagaagccaacagtctgagccatctgagcacagaaagtggagagcatgctggcgagggctggtgttctcagccgaggctagcttggacttgccaagtacctgaggcaatgtcactgattctgccatcctcaggctgcctgaccttgggctggtcactcattccttgccagatgaagccatccagttgtagcagcagtgacaacacaaagctcacagaggggccaaggctgggagggcaaatatgttttatgtcatgagctaacacctttcaattggttgtggccagctggaaagttgggttgattctgcaggtcagttcttgacaggaaagggacctctaatcccctagtagggtctgctgttggaaatgagaggtgggctcctgagactgtgaaacaaacggccgactgtggattccagttgccaggtccacctataatggcatcggcaaatatttcaaacaacacataattctgtccttgatgaaatgacacatcgtgaatggtgaatccatcaattccactttcccttagtggtgggtagagaggcaaggagctctgacaataatcagccttccatgtggagctaagatcatcttcatctgcagaaaaaaagcaccctggagatggatccaagaggggcaatgctcagagttccaccaaacaggcctaggccagcatgtcccacagccccaggtagggtgcgcactgtttgcatggagtctgattacttatccaggccacgaggctggagccagctctctctgctgcgccagttctgctaacactaggtactcccaggccttgttgtcattacttgcagattgctgaaaagtgtcagctttacctttctttttttccatagatcgaatgaataggcttccgggggagaagaccgaagcgcagctctgtttttccaagcccatggcatggcttgccaagaatgaattaaatgtttccacagaatcatttgctttgtttctaatcggctctgtgaagtattttccttcttcccagtggtttaagagggactcattggctcccttggccaggcccctcaggctggggcttttgggaaaggaagaaatggaaaaccatgagaggcccttcaagaaatctaagggtggaggatgattgtggcctagcacaagtagattatcagaaaacacagggagctgttctgccagggctatggcgacggagatgacaggggtgcaagggtcttggggtcatcagccctggggtacagccaaatcaacagtggtggtccagatgctaattctttggcttgctcctactggtaggttgtggccaatcatcttcaaatccatatctgcagctcagtggagagacttcctagggtagcccacgcactgtgatctccctctgagtggccttcgggctaccggttgctgtggtgaccatctgcaaatgccttggcaggtctggatgcggcactgttgctgcaaatgcttcttttctttcagttctggaagacaccgtgggttctcttttccaatctaattggccccatgctgagagtgtaataaaagcctctttttctccaggagtctaagactctcttttggaatgaaagagcactgctttccatgttgaattgcttctttggttcatctctccattacagcacactctttaaggacttgtgcagcccagtgagaactggactggaggccagcctcagtgacctggctttgagccacagcccacttgttctggggatcagtctctccctgagatttcacgtgctgtctccatcagctcaggattgtcctcccttgggacattgcttcagctgttgttcttttatcatggctggtttgtttttttgcttttgtttttgttttgtaagaaattgactgttattttcaaagcattcaggatctgtctttccttcaaacttcctccttctctcccatgagcagatcatcaatcatcactgggcttttcctaccaccattgcataccaaacatctacaaatagcagagggcccatgcattggtcagagcagtgctctatgacacttaggcatggcatcattcccacttaaggcactcatggtggacttgactaatggagcaactctttcctggtgagcctcagaatccttctcaacaccatgcatcacactgctgctaccagtcctttagagctggtttttaggttaaaatctttttgccttccccagcttaggttccccattgcatctccccttcctctaaccaacattactgtgaatgctcagaattaatagctacttagtgctagcccacccatgaaattgacgctgataagatgtagattctgccagggaccttatagtttgttgcagctacatcaacaagatgtaagcatgcctgactgaggttgaaggaggtgctggacatacctctattcaagaagaattcatcccttttcagagtttatgaatgtgcctcttcttactattcatttatctctcagtgataaatgaattttatcctgcaaagtgaaaggcctaggggttgtagtccagaatttattgttcaggataagctgcatctgtcctgggagatagagcaactagatccaggacaatctgagacttatccagtaacatcatctctcacgcagtaaaccttgtcctaaccaggccaacccctggtcttaagaacagttataatacctgtgggttctgctatgtggacactttatctctaacatgaaagaggagggaagtgatgaattgcagctcaattactgacatgggttggcctggatttttgattcattaataagtactaaaggggaaaaattctaagagaaatgaaataggaatttaatatttgaaatagttaaaagataggttattcattagagcatcaacaaaccactacaaaagcgagcaaaaataaataaaataaaatcctgagtgctagcctttctagaaatccaggaggactcaatgatttcgctaatgggtagctaggaatcacttccttccaaccctcccccttggccccattgctgcatagatcctctggctcgatggtgtgggtttgagactttaatatttgcctgcatttctgacatgcagaaaatccctttagcccttctgttttcagtttgctggctttgcttgtgctagccgtgtgctgcactcgcggactatacgaatcccaggccttagggctgcctgtcctcctctgacaatgggcctccccagacacttgcctgagtcctgtgatccagaccaggccttgtcacaaaattcaaaccttgcttctctgcccatcactccagtttctccaagaatgagggttagggccttgcccttattttctccagctcaaccaggggtttcttctctggcccaggttggcttcccatgctctccaggccttagcatgactccctctactccacatcaactgctctcctgccctgttccgtggggcctttctccctccagttggaatacagtgaaaagttgctttttcagcttttcctttgctttctggtgcctgaaaacacatgcacttaccattttcatcttacctgggttgttggtatttagtcttgggcaagggaggacactttaatataaccatggcccttggactgtaatttctaatgtttttctctggaatggtagctgccctgtctctgagatttttgtcattgatttttactgctgaggggtggacccattcattcaacctgggggcttctagtgatttattattccaagttaagacaattttatgaatgaaatgggctgttattgatagttatgacagaataacaggaatacaccagtactattccaggtgaaagttgtattcttagcctgaccttgtctttagcagccaacatagagcaaacttcacttgtccaggggttgtatctggggccatttctcttggaattgatagatggatgtgatggccaccatgcccagcatgtaagcacatggctttaaactctcataatggagcagctcttaggttgacccttttgtaagttcgtggacttagacaagtaattcctttggtgattctcaatttccccatctgtacaaggagtataatggtaactgtcttataaatggctttaaagattaagtaagacaacatcgataaagcatttgacttgagatagttcaatgaattctagtttccttttcttcatcttttcctaatgaggcccacagagcatgtcaacccatttctaattcctctcctttaatggaaagatggtctgtgatctgctattcaatattccttgttaaaatggattctcagttttgcatttccaatgccttctaatgtaaaataaatttcagcccaaaaaaagggctgaaattcaatacattaagggaagtaattttaatgtatgagatggaaagagagatttagcttaggatcccaaatatgcaggagcatgagatgcgttgggagcatgattctgctaaagcttcagggatggaaaaaggaatcctgtgctgggacataattaaatgacttgagaagacggctaatggtattaaaatgaaaactttaagctctagactactaattttaattccacagtgaaaggtatcgtgctgttgctggctgctgagagaagagagtgaccagagcccactgactgtaataccatggaacagtgtttgtctcagacagaagggctggcttcaaatctttgctctgccattcgtcaaccttgcccttgaatcagaccctcacactctctcaacttctgttttcctacctgtaaaatgggtgcaataatatgtgctgaagagatctgtgatgagaattatgtgagaaactttattttgtttatttttacttaaagagacctagcacacctggcagcatgtgactgtcaattatactgtgaaatgggttaatgagttagtttttatttcttcttttttaggactctgaattgaatctggaaatatatatgccctttcatctcttcttttaacttcaactctatttttctgcagggattaataaaagtttcttgtttttagagctttggtgcctagatctgtaataacaactgaatattatgggtgtactaagtgagaagcttaaggggcatctgattagaaattctctggactcttattaggctagtctggacccactggtccatgaaacactacttttgtgggatgttaatagttattcctccaaaaatagaatgcaaattcagatgtttttgagaaaccctggataaataaaatgaaattgattcctttattgcaatttttcagatagttaaatgagccaaggtgcattgtgaatctccagcatggggccatgtgacatgcactgtctcccaaacatgtttgaccatgttccccatttttttgtgggatatttttagagaccagtggtccatggcatgctttgacaagtactgttctgatactttttataaatttgaaaaaaaagtttacattctaatattaagtgcaaaagcaagctactaaatgtcataaactataaaatcatgattatggtaacatgtatttaagaaacaggcaggaaatctattaaaatattaacctatcaactaaaagagtaatcttggggagggagacttacagtttttatatttattttgcttcctatattttctagtttttctacaatgaacatgtattgcctttatagttcagcaaatttacttttcttttttcttttggttaagcagtctcagaaggaatcattttctttccacctacaatgttagatccacctgaatgaaatacgcctttcattgcgtcctgagaagacggaagaatcataaaaagccttcagaagcccttgaggaattttgagggcagtaaaagcaaagactgtaaaccgaagaaaaatacacaaagatgtaagagcagtaagagcaaagtggggacaagggatattgagtatctgaagggaaaaataagaagcatagcctatcctggaaaagaaaagaaacgtcatggtaaaaaaacaactgcggtttttgtgaacacctactacggtaaggaacaggccagccatagcccacacccaggtggctgacaagagctcgccagatcacagggccaccttcctgcctgagagctggatgccctctgcatcttcctgggctttacagcacatgggatctgtttacatgtggtctccgcagactcgtgtcaagatcctaagtcagtgaatcccgagggaagcaaaaggcaggggtggaagcatggtaaggaggtgtaaacacccttttgtaagccccatggaggggtataggcttcaacagggagcagtttaagatactttggagattgactgtttggggttaagtgttggctccactacttatactcatgtggttttagatgcttttcttaatctctctgtgctctggtttctgtaaaatagtaataagtatcctatttagttattttgaggactaaatagataattccagccctccatatccctgggtttctcatttgtaaattcaaccaactgtgggccaaaaatatatggaaaaaaatggaacgtgtactcaacatgtacagacatttttcttgtcattattctctaagcaatgtagtattcagcactatttacatagcatttgcagtatattaggtattataagtagcctagagataatttaaaggatgtgggaagatgtatgtaggttacatgcaaatagtacaccattttatataagggacttgagaattttggtaactgaaggggctcctggaaccaatttcccatagatacagaaaaatgactgcatatgtaaaagacttagcagtgagccttttataaatggttgcattagtattaataaagaagtaaataacacctataaatagttacccagggtttcccggattacagctgctatggtctgaatgtttaagtgctcccagaatttatatgttgaaacctagtcaccagtgctataatattaagaaatggggctttgggaggtgattgggaatggcattaatagcacaggaacagaaaaccaaacatgttctcatttgtaagtgggagctgaacaatgagaacacatggacacagggaggggaacaacacatactggggcctgtcatggggaggggaggagggaggaacagcattaggaaaaatagctaatgcatgctgggcttaatattttggtgatgggtctataggtgtagcaaaccaccatggcacatgtttacctatgtaacaaacctgcacattctgaacatggacctcggaacttaaaaaaagaagataaaaggcttgagcgagcctgtttgccccttccaccatgcgaggacacatacaaggcaccatctatgaggaacgagctcccaacgagctcccaacagatgctgattttgctggtgtctcgatcttggacaacctccagaattgtgagcaataagtttctgttgtttataaattacttagtctaaggtattttgctatggaaatatgaagggactaagacaatagcatataagaatgctatcctgatttctggacttcaaattacttataacatatttggcactctcagccagatacaggccatatttaggcaacactgaatgaggaaagttacttacttgcccactcccttctggagagtgggacgcaattatcaattgtgttgaaattctcctagatattatatgaggtgtctttaacttgagacttgcattagtcaggttttgatacaatgattctgcataacaaagaatccccaaatagcaacacatacttgtttctcattcacaggtctatgagtcagctatgactctgtggtgctttgctggcctcagctggacttggcttcaggctgtaggttgggttcatatctgatcaatggggctctcattctgagactcaggctgaaggccacctgaattctactcttctcacagtgaatgagaagctcataagagtacatgaggacagtaggaaacttgccatgtgtcttaaagcctcaccttggaacatgctgtctcctccatctatgttctattgctcaaagcaagttatatggccaagtccaatgccagtgggatggaaagtacactctgttcacaggacagtcacagcagtggcaaagcgggaaggaggaatcatggacaaataataaatactatttatatactacaaggatctataaaaataacaaaagaatgagctgagaaggactgaactcacattatggcacagacttagaacagtttagcaaacaataaactgcaattgcatcgtgtttgtgtattctaaactcacaacccaaaccccttcaaaatctagtcagacaaaaccagcaaattatccgtaaagatgcatgtgcacatgtacccagaggacttatggtgcaaagcgcatacccagcattaaccatgacacccttctagtcttgcttacaaaacccctctcaccaaggctctggagaaaccctagccagaaaaggcaagaagaaaaggcctgggtcagttcccagctcacttataaaccttcctgatccagacagtgcttggatcagagctgatctgcccctgatgaggaatttttaagtctctctctgctattgttttcagttgagcgcaatcatcaactgaacaccttttatgctggtcctttctgtcatttttggctactgcacacatatatacatattcagggatgtcaagtggggaatttctctttcaaatgttcaatacataaataattacataaaacagtgaatgagtatctgcaaaagaacctgctgtggaagccaagggactacaggtgggagacaaatgaattctgactagcactttcagatgatttcctcacactcagcagtcctttatctgtgattacttcctgtgtcctgctatcactttcctgctcctcccctacttttttatctgccccaaagctagagtttgaaattgtctaataatttcattcacttatacttacattactatttaccatctaaatgagttaattggctccacttggaacactgacattctctttcagttcccttttttttttttttttctgggcaaaatcatttgctagctttatccttatgggttgaaaaggcacatattccaccctgggaggaggccatttcctgttcatggaacctgcccgtcctgagtgttcactggagaggcggtggactcacccccttctcagttcaaggacatactcgggctacttcttttccagctggtagatacacaggaagatactgcatctcatggactaatggactttcaagtcagcttgggggggtcacatctgttttatgcaagcagacaaggtgaattattgaactaacagctttctcaggtatgggctctgcagtgtgattaattatgtataatgtgcactcaggcaaaaaatgaggtgtttaaaggctgctggagtcattccaccttcaaacaaggaagagcaagctgaagacttttgtagtgtcttacactcacccatggtggctgaattgataagagaagcatcagacttgtcagggagaaataatgtggtctcctctgttttggagtagtgtttgtcctctccagatccctttgtaatttttgtctgactttcttttgcctggcatatagtgcatggcacaatacaatagcagggataataacagctaccatagcattgagtgtgttaggtgtataactcggtgtattattttttatttatttatttatttattttattattatactttaagttttagggtacatgtgcacattgtgcaggttagttacatacgtatacatgtgccatgctggtgtgctgcacccactaactcgtcatctagcattaggtatatctcccaatgctatccctccccccgccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctagtgacggtgagcattatttcatgtgttttttggctgcataaatgtcttcttttgagaagtgtctgttcttgtccttcgcccactttttgatggggttgtttgtttttttcttgtaagtttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccatcgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttgggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccctgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtaccctgagactttgctgaaattgcttatcagcttaaggagattttgggctgagacaatggggtttcctagatatacaatcatgtcatctgcaaacagggacaatttgacttcctcttttcctaattgagtaccctttatttccttctcctgcctaattgccctggccagaacttccaacactatgttgaaaaggagtggtgagagagggcatccctgtcttgtgccagttttcaaagggaatgcttccagtttttgcccattcagtatgatattggctgtgggtttgtcatagatagctcttattattttgagatacgtcccatcaatactgaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatatgctgctggatttggtttgccagtattttattgaggatttttacatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacaatttcagctcctgttattggtctattcagagattcaacttcttcctggtttagtcttgggagagtgtatgtgtcaaggaatttatccatttcttctagattttctagtttatttgcgtagaggtctttgtagtattctctgatggtagtttgtatttctgtgggatcggtggtgatatcccctttgtcattttttattgagtctatttgattcttctctctgtttttctttattagtcttgctagcggtctatcaattttgttgatcctttcaaaaaaccagctcctggatttattaattttttgaagggttttttgtgtctctatttccttcagttctgctcagattttagttatttcttgccttctgctggcttttgaatgtgtttgctcttgcttttctagttcttttaattgtgatgttagggtgtcaattttggatctttcctgctttctcttgtgggcatgtagtgctataaatttccctctacacactactttgaatgcatcccagagattctggtatgttgtgtctttgttctcgttggtttcaaagaacatctttatttctgcgttcatttcgttatgtatccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataagtgtggtgtgatgctgaaaaaaaagtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgcattatgaatctgggtgctcctgtattgggtgcatatatatttaggatagttagctcttcttgttgaattgatccctttaccattatgtaatggccttctttgtctcttttgatctttgttggtttaaagtttgttttattagagactaggattgcaacccctgcctttttttgttttccattggcttggtagatcttcccccatccttttattttaagcctatgtgtgtctctgcacgtcagatgggtttcctgaatacagcacactgatgggtcttgactctttatccaatttgccagtctgtgtcttttaattggagcatttagtccatttacatttaaagttaatatagttatgtgtgaatttgatcctgtctttatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagctagtttggctggatatgaaattctgggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcattttaactttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcatttctttttattcttttttctctaaactttccttctcgcttgatttcattcatttcatcttccattgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacctctttgcctttggtttgaacgtcctgccatagctcagagtaatttgatcatctgaagccttcttctctcagctcgtcaaagtcattctctgtccagctttgttcctttgttggtgaggagctgcgttcctttggaggaggagaggtgctctgatttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctacagtgtgaggtgtcagtgtgctcctgctggagggtgcctcccagttaggctgctcgggggtcaggggtcagggacccacttgaggaggcagtctgcccgttctcagatctccagctgcgtactgggagaaccactgctctcttccaagctgtcagacagggacatttaagtctgcagaggttactgctgtctttttgtttgtctgtgccctgcccccagaggtggagcctacagaggcaggcaggcaggcctccttgagctgtggtgggctccacccagttcgagcttcccggctgctttgtttacctaagcaagcctgggcaatggtgggcgcccctcccccagcctcgctgctgccttgcagttttatctcagactgctgtgctagcaatcagcgagactccgtggggtaggaccctctgagccaggtgagggatataatctcgtggtgcgccgttttttaagcccgtcggaaaggcgcagtattcgggtgggagtgacccgattttcccgattttccaggtgccgtctgtcacccctttctttgattaggaaagggaactccctgaccccttgcgcttcccgagtgaggcaatgcctcgccttgcttcggtttgcgcatggtgcgcgcacccactgacctgcgcccactgtctggcactccctagtgagatgaacccggtacctcagatggaaatgcagaaatcacccgtcttctgcgtcgctcaggctgggagctgtagaccagagctgttcctattcggccaacttggttcctccccca

SEQ ID NO: 12521 - DNA, 4851 bp, Homo sapiens
ttttttattttatttattttcttattattattatactttaagttttagggtacatgtgcacaacgtgcaggtttgttacatatgtatacatgtgccatgttggtttgctgcacccattaactcgtcatttagcattaggtatatctcctaatgctatcccccctccccccaccccacaacagtccctggtgtgtgatgttcctcttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatccttttttatggctgcatagtatatggtgtatacgtgccacattttcttaatccagtctatcattgttggacatttgggttggttccaagtctttgctattgtgaatagtgccacaataaacatacgtgtgcatgtgtctttatagcagcatgatttacaatcctttgggtacatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgatcgccattctaactggtgtgagatggtatctcattgcggttctgatttgcatttctctgatggccagtgatgatgagcatttttcatgtttttttggctgcataaatatcttcttttgagaaatgtctgttcatatccttcacccactttttgatggggttgtttttttcttgtaaatttgtttgagttcattgtagattctggatattagccctttgtcagatgagtaggttgcaaaaattttctcccattctgtaggctgcctgttcactctgatggtagtttcttttgctgtgcaaaagctctttagtttaattagatcccatttgtcaattttggcttttgttgccattgcttttggtattttagacatgaagtccttgcccatgcctctgtcctgaatggtattgcctaggttttcttgtagggtttttatggttttaggtctaacatgtaagtctttaatccatcttgaattaatttttgtataaggtgtaaggaagggatccagtttcagctttctacatatgggtagccagttttcccagcaccatttattaaatagggaatcctttccccatttcttctttttgtcaggtttgtcaaagatcagatagttgtagatatgcggcattatttctgagggctctgttctgttccattggtctacatctctgttttggtaccagtaacatgctgttttggttactgtagccttgtagtatagtttgaagtcaagtagctcgatgcctccagctttgttcttttggcttaggattgacttggcaatgcgggctcttttttggttccatataaactttaaagtagttttttccaattctgtgaagaaagtcattggtagcttgatggggatggcattgaatctataaattaccttgggcagtatggccattttcacgatattgattcttcctacccatgagcatggagtgttcttccatttgtttgtatccccttttatttcattgagcagtggattgtagttcttgaagagctccttcacatcccttgtaagttggattcctaggtattttattctctttgaagcaattgtgaatgggagttcactcatgatttggctctctgtttgtctgttattggtgtataagaatgcttgtgatttttgcacattgattttgtatcttgagactttgctgaagttgcttatcagcttaaggagattttgggctgagatgatggggttttctagatacacaatcatgtcatctgcaaacagggacaacttgacttcctctattcctaattgaatgccctttattcccttctcctgcctgactgccctggtcagaacttcccacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcgatacctaatttattgagaatttttagcatgaagggttgttgaattttttcaaaggccttttctgcatctattgagataatcatgtggtttttgtctttggttctgtttatatgctggattacatttattgattttcgtatgttgaaccagccttgcatcccatggatgaagcccacttgatcatggtggataagctttttgatgtgttgctggattcggtttgccagtattttactgaggatttttgcatcaatgttcatcaaggatattggtctaaaattctcttttttcgttgtgtctctgccaggctttggtatcaggatgatgctggcctcataaaatgagttagggaggattccctcattttctattgattggaatagtttcagaaggaatggtaccagctcctccttgtacctttggtagaattcggctatgaatccatctggtcctggactttttttggttggtaagctattaattattgcctcaatttcagagcccgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttgtcattttttattgtgtctatttgattcttctctcttttcttctttattagtcttgctagcagtctatcaattttgttgatctgttcaaaaaaccagctcctggattcattgattttttgaagggttttttgtgtctctatttccttcagttgtgctctgatcttagttatttcttgccttctgctagcttttgagtgtgtatgctcttgcttctctacttcttttgattgtgatgttagggtgtcaattttagatctttcctgctttctcttgtgggcatttagtgctataaatttccctctacacactgctttgaatgtgtcccagagattctggttttttgtgtctttgttctcgttggtttcaaagaacatctttatttctgccttcatttcgttatgtacccagtagttattcaggagcaggttgttcagtttccatgtagttgagcggttttgagtgagtttcttaatcctgagttctagtttgattgcactgtggtctgagagacagtctgttataatttctgttcttttatatttgctgaggagtgttttacttccaactatgtggtcaattttggaataggtgtggtgtggtgctgaaaagaatgtatattctgttgatttggggtgtagagttctgtagatgtctattaggtctgcttggtgcagagctgagttcaattcctggatatccttgttaactttctatctcattgatctgtctaatattgacagtggggtgtttaagtctcccattattattgtgtgggagtctaagtctctttgtaggtcactaaggacttgctttatgaatctgggtgctcctgtattgggtgcatatatatttaggatagttagttcttcttgttgaattgatccctttaccattacataatggccttctttgtctcttttgatctttgttggtttaaagtctgtttaatccgagactaggattgcaacccctgcctttttttgttttccattggcttggtagatcttcctccatccctttattttgagcctatgtgtgtctctgcacatgagatgggtttcctgaacatagcacactgatgggtcttgactctttacccaatttgccagtctgtgccttttaattggagcatttagcccatttatatttaaggttagtattgttatgtgtgaatttgatcctgtcattatgatgttagctggttattttgctcattagttgatgcagtttcttcctagccttgatggtctttacaatttggcatgtttttgcagtggctggtaccggttgttcctttccatgtttagtgcttccttcaggagctcttttagggcaggcctggtggtgacgaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacctgacctttctctctggctgcccttaacattttttccttcatttcaactttggtgaaatctgacaattatgtgtcttggagttgctcttctcgaggagtatctttgtggcgttctctatttttcctgaatttgaatgttggcctgccttgctagattggggaagttctcctggataatatcctgcagagtgttttccaacttggttccattctccccgtcactttcaggtacaccaattagacgtagatttggtcttttcacatagtcccatatttcttggaggctttgttcgtttctttttattctttttttatctaaacttctcttcacgcttcatttcattcattttgtcttccatcgctgataccctttcttccagttgatagcattggttactgaggcttgtgcattcgtcacatagttctcgtgccatggttttca

SEQ ID NO: 12522 - DNA, 6063 bp, Homo sapiens
gagctattttattattattactattattattattttttttaattatactttaagttttagggtacatgtgcacattgtgcaggttagttacatatgtatacatgtgccatgctggtgcgctgcacccactaactcgtcatctagcattaggtatatctccgaatgctatccctcccccctcccccctccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacgtgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatagggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggctttggttgccattgcttttggtgttttggacatgaagtccttgcccacgcctatgtcctgaatggtaatttctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattgccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaatagtgaatgggagttcactcatgatttggctctctgtttgtctgttgttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcataaatagctcttattattttgaaatacgtcccatcaatacctaatttattgagagtttttagcatgaagggttgttgaattttgtcaaaggctttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctactggattcgttttgccagtattttattgaggatttttgcatcaatgttcatcaaggatattggtctaaaattctcttttttggttgtgtctctgcccggctttggtatcagaatgatgctggcctcataaaatgagttagggaggattacctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagagtcttaatcctgagttctagtttgattgcactgtggtctgagagatagtttgttataatttgtgttcttttacatttgctgaggagagctttacttccaactatgtggtcaattttggaataggtgtggtgtggtaatgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatgtatatttaggatagttagctcctcttgttgaattgatccctttaccattatgtaatggccttctttgtctcttttgatctttgttggtttaaagtctgctttatcagagactaggattgcaacccctgcctttttttgttttccatttgcttggtagatcttcctccatccttttattttgagcctatgtgtgtctctgcacgtaagatgggtttcctgaatatagcacactgatgggtcttgactctttatcgaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgataattatgtgtcttggagttgctcttctcgaggagtatctttgtggcgttctctgtatttcctgaatctgaacgttggcctgccttgctagattggggaagttctcctggataatatatcctgcagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatggtctgaagccttcctctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttcatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgactcccagttaggctgctcgggggtcaggggtcagggacccacttgaggaggcagtctgcccgttctcagatctccagctgcgtgctgggagaaccactgctctcttcaaagctgtcagacagggacatttaagtctgcagagtttactgctgtctttttgtttgtctgtgccctgcccccagaggtggagcctacagaggcaggtaggcctccttgagctgtggtgggctccacccagtttgagcttcccggctgctttgtttacctaagcaagcctgggcaatggcgggcgcccctcccccagcctcgctgccgccttgcagtttgatctcagactgctgtgctagcaatcagcgagattccgtgggtgtaggaccctccgagccaggtgtgggatatagtctcgtggtgcgccgttttttaagccggtctgaaaagcgcaatattcgggtgggagtgacccgattttccaggtgcgtccgtcacccctttctttgactcggagagggaactccctgaccccttgagcttcccaggtgaggcaatgcctcgccctgcttcggctcgcgcacggtgcgcgcacccactggcctgcgcccactgtctggcactccctagtgagatgaacccagtacctcagatggaaatgcagaaatcacccgtcttctgcgtcgctcacgctgggagctgtagaccagagctgttcctattcggccatcttggctcctccccct

SEQ ID NO: 12523 - DNA, 16401 bp, Homo sapiens
tatgtagaaataatgtacttagtgatgcataagacaacagtccagattcagttttatttggttttatttcctacagtatagtgaggaataaaattggggttgatcaaggctttacagatttgagaagccttgaaaaccctacaaaaatatttagaatggatttcataagaaacaaaaaaaaagcatcagataatatttctgctgcatagagcagcataggaagataaaactggcatctgtgcccaggaaggacccaattgcatggagtgagagaccagccaggaaccacagtctcaacaatacgggcaaaggcaagtgaatccagaagatattagaggcagggacagagaggaaaagacagacatgtgagacatcagagcagaaaagcatcaggactgcatgcatgcaatggagagaaaggaatcaaagagagagagacaatgggatagtgttctgaaagactctagatcaaatttctctggatggatctaaatttccctgaccatatagaccatacaaaggacatccactttccactcagcttgattcattcatccaagtgacgtgtcctaactgttggtaagcattttgttgttgttgttgttttcctgtgaacaatcggtgaataaaccctttagtttttttgtgccatacagtctctgtcacaaatcctccacacagctgctatagtgctaaagcatctgctacaatgtgaatgcatcccgcaaatttcatgtgttggaaacaatcaccaaattcatgctgatagtattaggaggtagggcctttgtgatgattatggtagatgtggcagattagggtagttatgattaaataaagtcacagggtggagcctgcatgttgggactggtggctttataagaagagggcacgctcttgccctctcaccacgttatgacatagcaagaaggctctcatcagaagtggccccttgactgtggatttaccagcctccaatactatgtccaaataacctctattctttataaactacccagtctgtgatactcagccgtagcaacagaaagtgacttaagagagcatctttttttttcttttttatagctcctggactcagcctcacattttcttatcatttcttcttctttttttttaatacctttgttctttttttttatatacactttaagttttagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccggtgtgtgatgttccccttcctgtgtccatgtgttctcattgttcagttcctacctaggagtgagaacatgaggtgtttggtttttcgtccttgcaatggtttgctgagaatgatggtttccagcttcatccatgtccctacaaaggacatgaactcatcattttttatggctgcatagtattccacggtgtatgtgtgccacattttcttaatccagtctatcatttttggacatttgggttggttccaagtctttgttattgtgaatagtgccacaataaacatacgtgtgcatgtgtctttatagcagcatggtttataatcctttgggtatatacccagtaatgggatggctgggtcaaatggtatttctagttctagatccctgaggaatcaccacactgactttcacaatggttgaactagtttacagtcccaccaacagtgtaaaagtgttcctatttctccacatcctctccagcacctgttgtttcctgacttttaatgatcgccattctaactggtgtgagatggtatctcattgtggttttgatttgcatttctctgatggtcagtgatgatgggcattttttcatgtgtcttttggctgcataaatgtcttcttttgagaagtgtctgttcatatccttctcccactttttgatggggttgtttgtttttttcttgtaaatttgcttgagttcattgtagattctggatattagccctttgtcagatgagtagattgcaaaaatgttctcccattctgtaggttgcctgttcactctgatggtagtttcttttgctgtgaagaagctctttagtttaatgagattccatttgtcaattttggcttttgttgccattgcttttcgtgttttagacatgaagtccttgcccatgcctatgtcctgaatggtattgcctaggttttcttctagggtttttatggttttaggtcgaacatttaagtctttaatccatcttgaattgatttttgcataagatgtaaggaagggatccagtttcagctttctacatatggctagccagttttcccagcaccatttattaaatagggaatcctttccccatttcttgtttttgtcaggtttgtcaaagatcagatagttgtagataagcagcattatttctgagggctctgttctgttccattgatctatatctctgttttggtaccagtaccatactgttttggttactgtagccttgtagtatagtttgaagtcaggtagtgtgatgcctccagctttgttcttttggcttaggattgacttggaattgtgggctctcttttggttccatatgaactttaaagtagttttatccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctcttattggtgtataagaatgcttgtgatttttgcacattgattttgtatcctgagaccttgctgaagttgcctatcagtttaaggagattttggggtgagacgatggggttttctagatatacaatcatgtcatctgcaaacagggacaatttgacttcctcttttcctaattgaacaccctttatttccttctcctgcctgattaccctggccagaacttccaacactatgttgaataggagtggtgagagagggcatccctgtcttgtgccaggtttcaaagggaatgcttccagtttttgcccattcagtatgatattgtctgtgggtttgtcatatatagctcttattattttgagatacgtcctatcaatacctagtttattgagagtttttagcatgaagggttgttgaattttgccagaggccttttctgcatctattgagataatcacatggtttttgtcgttggttctgtttacatgctggattatgtttattgatttgcatatgttgaaccagccttgcatcctagggatgaagcccacttgatcatggtggataagctttttgatgtgctgctggattcagtttgccagtattttattgaggatttttgcatcaatgttcatcagggatattggcctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatttgtctgtgaatccgtctggtcctggactttttttggttggtaagctattaattattgcctcaatttcagagcctgttattggtctattcagagattcagcttcttcttggtttagtcttaggagggtgtatgtgttgaggactttatccatttcttctagatttttagtttatttgcgtagaggtgtttatagtattctcttatggtagtttgtatttctgtgggatcggtggtgatatcccttttatcattttttattgtgtctatttgattcttctctcttttcttctttattagtcttgctagaggtctatcaattttgttgatcttttcacaaaaaccagcttctggattcgttgattttttgaagtgttttttgtgtctctatttccttcagttctgctctggtcttagttatttcctgccttctgctagcttttgaatgtgtttgctcttgcttctctagttcttttaattgtgatgtcatggtgtcaattttagatctttcctgctttctcttgtgggcatttagtgctataaatttccctctacacactgctttgaatgcgtcccagagattctggtatgttgtgtctttgttctcgttggtttcaaagaacatctttatttctgccttcatttcgctatgtacccagtagtcattcaggagcaggttgttcagtttccatgtagagtgagcggttttgagtgagtttcttaatcctgagttctggtttgattgcactgtggcctgagagatagtttgttataatttctgttcttttacatttgctgaggagtgctttacttccaagtatgtggtcaattttggaacaagtgtggtgtggtgctgagaagaatgtatattctgttgatttggagtggagagttctgtagatgtctattaggtctgcttggtgcagagctgagttcaattcctggatatccttgttaactttctgtctcgttgatctgtctaatgttgacagtggggtgttaaagtctcccacttttactgtgtgggagtctaagtctcttcgtaggtctctaaggacttgctttatgaatctgggtgctcctgtattgggtgcatatatatttacgatagttagctcttcttgttaaattgatccctttaccactatgtaatgacattctttatctgttttgatctttgttggtttaaagtctgttttatcagagactaggattgcaacccctgcctttttttgttttccatttgcttggtagatcttcctccatccttttatttggagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttggtcctgtcattatgatgttagctgattattttgctcgttagttgatgcagtttcttcctagcctcgatggtctttacaatttggcatgtttttgctgtggctggtactggttgttcctttccatgttgagtgcttccttcaggagctcttttagggcaggcctggtggtgacaaaatctctcagcatttgcttgtctgtaaagtattttatttctccttcacttatgaagcttagtttggctggatatgaaattctgggttgaaaattctttaagaatgtcgaatattggcccccactctcttctggcttgtagagtttctgctgagagatcagctgttagtctgatgggcttccctttgagggtaacccgacctttctctctggctgcccttaacattttttccttcatttcaactttggtgaatctgacaattacgtgtcttggagttggtcttctcgaggggtatctttgtggcattctctgtatttcctgaatctgaatgttggcctgccttgctagattggagaagttctcctggataatattctgcagagtgttttcctacttggttccattctccccagcatccttaataatacataaacaaatgagcttggctatgttccactaaaactttatttacaaaaacaggttgagggctagtttggctcacaggatgtagtttgctaaactttgccctgtaacatttgaatttgcaatccttggcctttgaggcccaaagttcttgccctgggtcttccttctgatcctgtctaccatttcctactacttactcttgattccagccatagcacactacctgcttttctcaaaagatatcacagatttttacatccagagcggtatactccagtcctcccatgcttgttacccctcattaactatttctcattatttgaggatgagttcagaagttaccccattagggaacattttctaaatcccccaactccccccacaacagcagatgaatactctgttacctgtttccatagcactttaaaatatctctaccttaacccttatcatagcatatttctataattttggaaagaactttgtcttcgttttctttgtatttcacacccacccctcacccaaaccaaatatctaaaacaattcccagaatacagtaggtgtttaagaaatgtttatgctgtgagagcatatagttttaaaaggaatttgggtttctgatcaagggagactgcatttttgccaagcccaaaataatcgttttataagatagttaataaaaagtacaaagctctaagagacaaatacctatcaaaagggcatcccccccccaaaaaaaaaactcctttattttatttctgaaataatattaagtgaattagtagatacttgctatcaatggattctattacttagagggtggtatttcttttcttaaattgtttcaaaagtcaaaattatgtaaatagtcttgccattttctcacaatgtcagaagaggagtataaaaatatatttgtccatgatcaagatctatgaacataacctggtcccaggcttcctgagaatgagatgacttttcttttccttctataactatgatgattgagataatggtcaattacaacattctcttctcccttgaagctccgacatttgggtttctttctttactttataattgagatgttattggttgtgttgaggatcagtacatagacatttcaatttgtacacaattcttagcatacataccaaaaatctgaaaggccatgaattgtaatttctttacacagtcattccaggggctttctagcttaaaatttggaggtaaattttccttaagaggctatcaagtaccagtatcttcaaatgttgataagctgtttcatacatcccaccaattaataatttaataacatatatactacatactcaaattttcaatcttaaacactacattaacaaagttgttaggaaaatgggactaccacagccaaagatataacaagagtgcacacaattctgacagggagagccatgatcaaggagcagttttctttaggaaacaaatctaaaaaacaacaagaaaatagaagtgattcaaaatgctcaagacattaaatgcaggagtgtgactccatattgccatttagtatgtttagtattagaggatataagaactaactgcctatttatggaatgttaagctgacacccaatacagtcaaagcctcccataattcaatatcccacactattttctgattgtaccaaaaataatcaaccagctaatgtttttaccccttaaaaaagaatttacactaaaaaaaaaaatgagataaggtgggacttcctctttctcaaaaaaagtttcctgagctactaaagaaacttgcatttataaaatagttgatagaaatagtactctggattgtacaagggagacagggaccactgataaggtggggtatatgatattaatcagaattggcttctttctctctggcttcatcagaggctggacattcttcagttttagtttctccattttgtgcaggtaaatcttctttagtttcttggctagccactttggcctgtttaccctttgcttccctgcccaaaaggaaggtcagctcagcacaaggggtggtgaaggaagagcccaagaggagatcagtgaggttgtcagctaaacctgctcctgcaaaagtagaaatgaagccaaaaaaagttagcaggaagggataactcttcagacaaaaaagtagcattacagcaaattattcaagtgcaattgtgtaaaaattattcaaatgcaattgtgtaaaaatcctcttgacacagaacaagatagaaagacttcagactatctcctatttccactgaccccacccatgtcataacaaaacatacatttcttggaaatgagatggttctaattttgtgttaccacgttctttcagtgacagtatattgtccattccagttgaagaaagaaatgtaatgtggtaaatatccaagaaaccttggacagaagagccagattagtccacgggcatcagcacattccacaccttatttcttattgactagtatcagatgaactcagtagtccataaatcacagaagacttttggagttcagccattttccaagaaacagcgaagtaaaggctgtgggagccaactgacttggccaaagcgtaaagctcgtaaatgtcaattagcccacaagaacaagcattttgtgccaccaagcatgggtatgtcaactttagcagtgcagagaactcttccaacaagtttaaacaggttgtaagtttgtgtagcatatttgtcttgtttaggggatcatttaatttcaaagcaccttgcctcaccatcttatattatttttttatatgctatgtgttaagaaagtttgatttctgtttgctacagattcagataatctgttagtccccattaatctctaccttttgggtccaaggatgatactcctggttttcataaactccagccaagacaccacatgcttcttcaacatcacaacactttctttcagccaacaattatatattattatgcttggtattgtctatttgtgatcaggtccatttctacccctggatttgcccagaccctgatatactactttcctataacctttactctttctgccttatgaatcatcaagtcagataagatccaactaaaaagtattcatacattcaatatatattcatcttgggtttcagaaggttttggtatccgtctattaattgttctgtttcaaatgaatgtccaataaacagccagtaattgacatccaaaggaaatgtaccagcagcctcaggacatcctgaggccagaaacaggctggtcttgttgaccctttctgggacctatcaaggggttcatgccaccccacagttgaagacagataccaagaaagatagccatgatgggaaccatgagaacattcagaaccagaaatgctccatatgggtagtgatatgcttaatctgaactacaggggatggcccagttggtccaagaaagtttacagactgtagagcatgcctaaacttccagactaggacagtctgcccttataacaaaatctctgctttacctaagtgctctcagtactgatcaagcctttatctcatgcaaccttgacgtgaatcctcagaggataaacacccaggcatggttatggggaaaaggaagagaaaccatatgcatgagcaaattacagcttcaacatgtgcggtggggctgtttccaaaaacagaggagggcttataagtaggtgttcggttggaactccattgtagagagtagtgaaaatgtggagtggaacaatatttgaagtatgcacaaacgccagataacctggccaaagagtaaacagtttgtccctcacaaacaagacaagtagtcccattatgggtcatttgtcctttggctatattagaaaatatttctcaaagttataacacctgaattattggaactttctggtaccctaattttaacacaggaggaagtattgtcctgtggtaaatgaatacaaagttcaccgggtaaaattttttaaatgctggacctgactctagaagtcaggtatatacatcctttaaatgtatatcctgttccactgcattaaatgctatgtgtggtctagaatatgtgcacccctaaatttaaacatgtacatccttaaagtgagcctccttttgacatgtagattagagcttggaaggctttgggggaataccacaagtggagttctgactgaataaatgatgttgccttcactcatctgactgccaagcacaccatgggatgagtagtaaagaagcacaggaagtgaaatgcgcttgatcatctgcatcaacaaatgcttttgagtctagtcacatggcagtcactgtaataggtttgaagataggggaagaaaagatccttgctctcaagaacttacagatgaacaaagagtacagacaatgattcagaaaatgtacttgttttgatagggatatacataaaatgcaacggaaacattgcagtgggggctatcacagaatttggatggatagtgtgtgtgtgttgttggggggtggttggactacatcacaggaaacttcttgtaggtaatgacctctaacttggaaactgaaggatgtttaagaattagcagaggagtattaaggtacaggctaagctgctctccagtgcctcaacaagttacaaatttatctcttcattttataaaaattccaacatgggaaggtagtgcaaggatgtaggaagctctacatcattacgtcatttaggaaccctagttcctactgtcaagaacatgaagggtctgagattttatctacttgtgagataatgatttcacatgtcatagttccatgaatggaaacagatacgagattcctgggtcagagcaacaacggaccgtattagtcaacgcaatagtgggagccagaatatcagcatttgttccagttacctgaggctcaaatctcacaggacacaatgaaaggagcaggagacatctgtactggcagtggtttactttataagaaaggaaccctaaactttgaaaatgaaatctttcataatcagtagtaagtctgcctgacttttgccccagaggaagacattgtttttactatcctgagtagttaacacattttcccagtgctctggaagaagacactatctctatcttccaaggctgtttgctataccatgggccttgaaaagaaaagaagaaaacagagtaattcagaacccctgctcaaagctgggcagaaaaggcagaaaagtaagacccatggagaattgtctttcaatgcctttttttttaaatttattattattatactttaagttttagggtacatgtgcgcaatgtgcaggttagttacatatgtatacatgtgacatgctggtgtgctgcacccactaactcgtcatctagcattaagtatatctcccaatgctatccctcccccctccccccaccccgcaacagtccccagagtgtcatgttccccttcctgtgtccatgtattctcattgttcaattcccacctatgagtgagaatatgcagtgtttggttttttgttcttgcaatagtttactgagaatgatgatttccaatttcatccatgtccctacaaaggacatgaactcatccttttttatggctgcattgtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatggtatctcactgtggttttgatttgcatttctcagacggccagtgatggtgagcattttttcatgtgttttttggctgcataaatgtcttcttttgagaagtgtctgttcatgtccttcacccactttttgatggggttgtttgtttttttcttgtaaatttgcttgagttcattgtagattctgaatattagccctttgtcagatgagtaggttgtgaacattttctcccattttgtaggttgcctgttcactctgatggtagtttcttttgctgtgcagaaactctttagtttaattagatcccatttgtcaattttggcttttgttgccattgcttttggtgttttagacatgaagcccttgcccacgcctatgtcctgaatggtaatgcctaggttttcttctagggtttttatggttttaggtctaacgtttaagtctttaatccatcttgaattgatttttgtataaggtgtatggaagggatccagtttcagctttctacatatggctagccagttttcccagcaccatttattaaatagggaatcctttccccatttcttgtttttctcaggtttgtcaaagatcagatagttgtagatatgcagcgttatttctgagggctctgttctgttccattgatctatatctctgttttggtaccagtaccatactgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttcaatttgtttgtatcctcttttatttccttgagcagtggtttgtagttctccttgaagaggtccttcacatccattgtaagttggattcctaggtattttattctctttgaagcaattgtgaatgggagttcactcatgatttggctctctgtttgtctgtggttggtgtataagaatgcttgtgatttttgcacattgattttgtatcctgagactttgctgaagttgcctatcagtttaaggagattttggggtgagacgatggggttttctagatatacaatcatgtcgtctgcaaacagggacaatttgacttcctcttttcctaattgaataccctttatatccttctcctgcctaattgccctggccagaacttccaacactatgttgaataggagtggtgagagagggcatccctgtcttgtgccagttttcaaagggaatgcttccagtttttgcccattcagtatgatattgtctgtgggtttgtcatatatagctcttatagttttgaaatacgtcccatcaatacctaatttattgagagtttttagcatgaagggttgttgaattttgtcaaaggccttttctgcatctattgagataatcatgtggtttttgtctttggttctgtttatatgctgtattacatttattgatttgtgtatattgaaccagccttgcatcccagtgatgaagcccacttgatcatggtggataagctttttgatgtgctgctggattcggtttgccagtattttttattgaggctttttccatcaatgttcatcaaggatattggtctaaaattctctttttttgttgtgtctctgcccggctttggtatcaggatgatgctggcctcataaaatgagttagagaggattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagaaattcaacttcttcctggtttagtcttgggagagtgtatgtgtcgaggaatttatccatttcttctagattttctagtttatttgcgtagaggtgtttgtagtattctctgatggtagtttgtatttctgtgagatcggtgatgatgtcccctttatcattttttattgcatctatttgattcttctctctctttttctttattagtcttgctagcagtctatcaattttgttgatcctttcagaaaaccagctcctggattcattaattttttgaagtgttttttgtgtctctatttccttcagttctgctctgattttagttatttcttgccttctgctagcttttgaatgtgtttgctcttgcttctctagttcttttaattgtgatgttagggtgtcaattttaggtctttcctgctttctcttgtgggcatttagtgctataaatctccctctgcacactgctttgaatgcgtcccagagattctggtatgttgtgtctttgttctcgttggtttcaaagaacatctttatttctgcattcatttcattatgtacccagtagtcattcaggagcaggttgttcagtttccatgtagttgagaggttttgagagagattcttaattctgagttctagtttcattgcactgtggtctgagagatagtttgttataatttctgttcttttacatttgctgaggagagttttacttccaagtatgtggtcaaatttggaataggtgtggtgtggtgctgaaaaaaatgtatattctattgatttggagtggagagttctgtagatgtctattaggtcagcttggtgctgagctgagttcaattcctgggtatccttgttgactttctgtctcgatctgtgtaatgttgacagtggggtgttaaagtctcccattattaatgtgtgggagtctaagtctctttgtaggtcactcaggacttgctttattaatcagggttctcctgtattgggtgcatatatatttaggatagttagctcttcttgttgaattgatccctttaccattatgaaatggccttctttgtctcttttgatctttgttggtttaaagtctgttttatcagagactaggattgcaacccctgcctttttttgttttccatttgcttggtagatcttcctccatccttttatttggagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttggtcctgtcattatgatgttagctggttattttgctcgttagttgatggagtttcttcctagtctcgatggtctttacattttggcatgattttgcagtggctggtactggttgttcctttccatgtttagcacttccttcaggagctcttttagggcaggactggtggtgacaaaatctctgagcatttgcttgtctgtaaaggatgttatttctccttgacttatgaagcttagtttggctggatatgaaattctgggttgaaaattcttttctttgagaatgttgaatattggcccccactctcttctggcttgtagattttctgccaaaagatccactgatagtctaatgggcttccctttgagggtaacccgacctttctctctggctgcccttaacattttttccttcatttcaactttggtgaatctgacaattatgtgtcttggagttgctcttctcgaggggtatctttgtggcgttctctgcatttcctgaatctgaatgttggcctgccttgctagattggggaagttctcctggataatatcctgcagagtgttttccaacttggttccattctccccgtcactttcaggtccccaatcagacgtagatttggtcttttcacacagtcccatatttcttggaggctttgctcatttctttttattcttttttctctatactttctttcttgcttcatttcatgcatttcatcgtccatcactgataccctttcttccagttgatcgcaccggctcctgaggcttctgcattcttcacgtagttctcgagccttggttttcagctccatcagctcctttaagcacttctctgtattggttattctagttatacattcttctaaatttttttcgaagttttcgacttctttgcctttggtttgaatgtcctcccgtagctcggagtaatttgatcgtctgaagccttcttctctcagctcgtcaaagtcattctccatccagctttgttccgttgctggtgaggaactgcattcctttggaggaggagaggcgctctgctttttagagtttccagtttttctgctctgttttttccccatctttgtggttttatctacttttggtctttgatgatggtgatgtacagatgggtttttgatgtggatgtcctttctgtttgttagttttccttctaaaagacaggaccctcagctgcaggtctgttggagtactgggccctgtgagctgtcagtgtgcccctgctggggggtacctcccagttaggctgctcgggggtcaggggtcaggggcc

SEQ ID NO: 12524 - DNA, 5647 bp, Homo sapiens
ttttttttaaaattttattattattatactttaagttttaggatacacgtgcacaacgcgcaggtttgttacatatgtatacatgtgccatgttggtgtgctgcacccattaactggtcatttagcattaggtatatcttctaatgctatcacttccccctcccttcaccccacaacaggcaccggtgtgtgatgttccccttcctgtgtccatgtgttctcattgttcaattcccacctatgagtgcgaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgtatgtgtctttagagcagcatgatttataatcctttgggtatataaccagtaatgggatggctgggtcaagtgatatttctagttctagatccctgaggaattgccacactgacttccacaatggttgaactagtttacagtcccaccaacagtgtaaaagtgttcctatttctccacattctctccagcacctgttgtttcctgactttttaatgatcgtcattctaactggtgtgagatggtatgtcattgtggttttgatttgcatttctctgatggccagtgatgatgagcattttttcatatgtcttttggctgcataaatgtcttcttttgagaagtgcctgttcatatcctttgcccactttttgatggggttgtgtgtttttttcttgtaaatttgtttgagttcattgtagattctggatattagccctttgtcagatgagtaggttgcaaaaattttctccccttctgtaggttgcctcttcactctgatggtagttactttggctgtgcagaagctctttagtttaattagatgccatttgtccattttggcttttgtcgccattgcttttggtgttttagacatgaagtccttgcccatgcctatgtcctgaatggtattgcctaggttttcttctacggtttttatggttttaggtctaacatgtaagtctttaatccatcttgaattaatttttgtgtaaggtgtaaggaagggatccagtttcagctttctacatatggctaagccagttttcccagcaccatttattaaataggcaatcctttccccattacttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagcgttatgcctccagctttttcttttgtcttaggattgtcttggcaatgtgggctctttttttggttccatatgaactttaaagtagtttttttcaattctgtgaagaaagtcgttggtagcttgatggggatggcattgaatctataaattaccttgggcagtatggccattttcaagatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttgcctctctgtttgtctgttatttgtgtttaagaatgcttgcgatttttgcacattgattttgtatcctgagactttgctgaagttgcttatcagcttaagaagattttgggctgagacgatggggttttctagatatacaatcatgtcatctgcaaacagggacaatttgacttcctcttttcctaattgaataccatttgtttcctgctcctgtctgattgctctggccacaacttccaacactatgttgaataggagtggtgagagagggcatccctgtcttgtgccagttttcaaatggaatgcttccagttttttgccgattcagtgtgatactggctgtgggtttgtcatagatagctcttattattttgagataacgtcccatcaatacctaatttgttgagagtttttagcatgaagggttgttgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagcttcttgatgtactgctggatttggtttgccagtattttattgaggatttttgcattgatgttcaccagggatattggtctaaaattctcttttttggttgtgtctctgtccggctgtggtatcaggatgatgctggcctcctaaaataaattagggaggattgcctctttttctattgactggaatagtttcagaaggaatggtaccagttcctccttgtacctctggtagaatttggctgtgaatccttctggtcctggactgtttttggttggtaagctattaattattgcctcaatttcagggtctgttattggtctattcagagattcaacttcttcctagtttagtcttgggagggtgtgtgtgttgaggaatttatccatttcttctagattttctagtttatttgcatagaagtgtttatagtattctctgatggtagtttgtatttctgtgggatcggtggtgatatcccctttatcattttttattgtgtctatttgattcttctctcttttcttctttattagtcttgctagagttctaccaattttgttgatcttttcaaataaccagctcctggatttaatgattttttgaagagttttttgtgtctctatttccttgagttctgctctgatcttagttatttcttgccttctgctagcttttgaatatgtttgctcttgcttctctagttcttttaattgtgacattagggtgtcaattttagatctttcctgctttctcttgtggacatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcctgagttctagtttgattgcactgtggtctgagagacagtttgttataatttctgttcttttacatttgctgaggagtgttttacttccaattatgtggtcaattttggaataggtgtggtgtggtgctgaaaagaatgtatattctgttgatttggggtggagagttctgtagatgtctattaggtccgcttggtgcagaacttagttcaattcctggatatctttgttaactttctgtctcgttgatctgtctaatgttgacagtggggtggtaaagtctcccattattattgtgtgggagtctaagtctctttgtaggtttctaaggacttgctttatgaatctgcgtgctcttgtattgggtgcatatatatttaggatagttagctcttcttgttgaattgatccctttaccattatgtaatggccttctttgtctctttttatctttgttgttttaaagtctgttttatcagagactaggattgcaacccctgcctttttttgttttccatttgcttggtagatcttcctccatccctttattgtgagcctgtgtgtgtctctgcatttgagatgggtttcctgaatacagcacactgatgggtcttgactgtttatccaatttcccagtctgtgtcttttaactggagcatttagcccatttacatttcaggttaatattgttatctttgaatttgatcctgtcattatgatgttagctggttattttgctcattagtttatgccgtttcttcatagcatcgatggtctttacaattaggcatgtttttgcagtggctggtaccggttgttcctttccacatttagtgcttccttcaggagctcttttagggcaggcctggtggtgacaaaatctctcagcatttgcttgtctgtaaaggatttttatttctccttcacttatgaagcttagtttggctggatacgaaattctgtgttgaaaattcttttcttttagaatgttgaatattggcccccactctcttctggcttgtagagtttctgctgagagatcagctgttagtctgatgggcttccctttgtgggtaacctgacctttctctgtggctgcccttaacattttttccttatttccactttggtgaatctgacaattatgtgtcttggagttgctcttctcgaggactatctttgtggcattctctgtatttcctgaatttgaatgttggcctgccttgctagattggggaagttctcctggaaaatatcctgctgagtgttttccaacttggttcctttctccccatcactttcaggtacaccaatcagacatagatttggtcttttcacatagtcccatatttcttggaggcgttgttcatttctttttgttcttttatctctaaacttctcttctcacttcatttcattcatttgatcttccatcactgataccctttcttccagttgatcgaattggctactgaggcttgtgcattcatcacgtagttctcttgtcatggttttcagctccgtcaggtcctttaaggacttctctgcagtggttttctagttagacgttcatctaatttttttttcaaggtttttaacttctttgccatgggtgcaaacttcctcctttagctcaagtagtttgatcatctgcagtcttcttctgtcaacttgttaaagtcatctccatccagctttgttccattgctggtgaggagctgtgctcctttggaggaggagaggcactctgctttttagagtttccagtttttctgctctgttttttccccatctttgtggttttatctacctttggtctttgatgatggtgacatacagatgaggttttggtgtggatgtcctatctgtttgttagttttccttctaacagtcaggaaccccagctgcaggtctgttggagtttgctggaggtccactccagaccctgtttgcctgggtatcagcagtggaggctgcagaacagcagatattggtgaacagcaaatgttgctgcctgattgttcctctggaagttttgtctcagaggagtacctggccgtgtgaggtgtcagtctgcccctactggggggtgcctcccagttaggctactcgggggtcagggacccacttgaggaggcagtctgtccattatcagatctcaagctgcatgctgggagaaccattactctcttcaaagttgtcagacagggacatttaaatctgcagaggtttctgctgccttttgtttggctatgccctgcccccagaggtggagtctacagaggcaggcaggcctccttgag

SEQ ID NO: 12525 - DNA, 6054 bp, Homo sapiens
ttgtaaagatttatttttttattttttttattattatactttaagttttagggtacatgtgcacattgtgcaggttagttacatacgtatacatgtgccatgctggtgtgctgcacccactaactcgtcatctagcattaagtatatctcccaatgctatccctcccccctccccccaccccacagcagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggccgcatagtattccatggtgcatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctacctggtgtgagatggtatctcattgtggttttgatttgcgtttctctgatggccagtgatggtgagcattttttcatgtgttttttggctgcataaatgtcttcttttgagaagtgtctgttcatgtccttcgcccactttttgatggggttatttgtttttttcttgtaaatttgtttgagttcattgtagattctggatattagccatttgtcagatgagtaggttgcgaaaattttctcccattttctaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctaggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatatggccattttcacgatattgattcttcctacccatgagcatggaatgttcttccatttgtttgtatcctcttttatttcattgagcagtggtttgcagttctccttgaagaagtccttcatgtcgcttgtaagttggattcctaggtgttttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttaaataggagtggtgagagagagcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgtagggttgttgaattttgtcaaaggccttttctgcatctattgagataatcatgtggtttttgtctttggctctgtttatatgctggattacatttactgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtattagaatgatgctggcctcataaaatgagttagggaggattccctctttttctattgattggaatagtttcagaaggaatggtaccagttcctccttgtacctctggtagaatttggctgtgaatccatctggtcctggactctttttgttggtaagctattgattattgccacaatttcagatcctgttattggtctattcagagattcaacttcttcctggtttagtcttgggagggtgtatgtgtcaaggaatttatccatttcttctagattttctagtttatttgcatagaggtgtttgtagtattctctgatggtagtttgtatttctgtgggatcgttggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttaccttctgctagcttttgaatgtgtttgctcttgcttttctagttcttttacttgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcggtttccatgtagttgagcggttttgagtgagattcttaatcctgagttctaatttgattgcactgtggtctgagagatagtttgttataatttctgttcttttacatttgctgaggaaagctttacttccaagtaaatggtcaattttggaataggtgtggtgtggtgctgaaaaaaatgtatattctgttgatttggagtggagagttctgtagatgtctattaggtctgcttggtgcagagctgagttcaattcctgggtatccttgttgactttctgtctcgttgatctgtctaatgttgacagtggggtgttaaagtctcccattattaatgtgtggaagtctaagtctctttgtaggtcactcaggacttgctttatgaatctgggtgctcctgcaggtgcatatatatttaggatagttagctcttcttgttgaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcatgtgagatgggtttcctgaatacagcacactgatgggtgttgactctttatccaatttgccagtctgtgtcttttaattggagcatttagtccatttacatttaaagttaatagtgttatgtgtgaatttgatcctgtcattttgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgagaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaacgttggcctgccttgctagattggggaaattctcctggataatatcctgcagagtgttttccaacttggttccattctccccatcactttcaggtacaccagtcagacgtagacttggtctattcacatagtcccatatttcttggaggctttgctcgtttctttttattcttttttctctaaactttccttctcacttcatttcattcatttcatcttccattgctgataccctttcttccagttgatcgcatcagctcctgaggcttctgcattcttcaggtagttcttgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttagaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagcctgcccctgctggagcctcccagttaggctgctcgggggtcaggggtcagagacccacttgaggaggcagtctgccagttctcagatctccagctgcgtgctgggagaaccactgctctcttgaaagctgtcagacagggacatttaagtctgcagaggttactgctgtctttttgtttgtctgtgccctgccctgcccccagagttggagcctacagaagcacgcaggcctccttgagctgtggtgggctccacccagttggagcttcccggctgctttgtttacctaagcaagcctggacaatggtgggcgcccctcccccagcctcgccgctgccttgcagtttgatctcagactgctgtgctagcaatcagcgagactccgtggggtaggaccctcccagccaggtgcgggatataatctcgtggtgtgctgttttttaagcccgtcggaaaagcgcagtattcgggtgggagtgacccgattctccaggtgccatccgtcacccctttctttgattaggaaagggaactccctgaccccttgcacttcccgagtgaggcaatgcctcgccctgcttcggcttgtgcacggtgcgcgcacccactgacctgcgcctactgtctggcactccctagtgagatgaacccagtacctcagatggaaatgcagaaatcacctgtcttctgcgtcgctcaggctgggagctgtagaccggagctgttcctattcggccatcttggctcctcctgttgtaaa

SEQ ID NO: 12526 - DNA, 7918 bp, Homo sapiens
ttttttttttttttttgagacggagtctcgctctgtcacccaggctggagggcagtggctcgatcttggctcactgcaagctctgcctcccaggttcatgccattctcctgcttcagcctcccaagtagctgggactacaggtgcccgccaccacccccggctaattttttgtatttttagtagagacagggtttcaccgtgttagccaggatggtctcgatctcctgacctcgtgatccgcccgcctcggcctcccaaagtgctgggattacaggcgtgagccactgcgcccagccagtaatatcttaagagtgtagcccatactttatcttggtactatatctaccacataatagttctcaatagatacgctgagtaaaagaatgaaggaattaaaatgaattaaacgttaaatacgtgtttcccaagaataaactgttttaaagtccatcatgagtcagaaactgaattggcagcagcaactatcagataaactatctgattgctggcacctgctctgtgcagaagggaaaaggaaactatcaatcaatgtcattgcaacctatcattattcttcacagcttcctttttttgagatggagtctcgctctgtcgcccagactgcagtgcagtggtgtgatcttggctcactgcaacctccgcctaccgggttcaagtggttctcctgcttcagcctccctagtagctgggactacaggcacatgccaccacacctggctaattgttttttgtatttttagtagagatggggtttcaccatgttagccaggatggtctcaatctcctgacctcatgatctgcccgccttggcctcccaaagtgctgggattacaggcatgagttaccttgcctggcccacagtttctttttaaacaaccctacgccttcttttccccaaaaaatgcaaaatgaaaaaaaattaaacttgcatttattcaatcatcaaacatccactgagcctttattctgtgtcatccttggacacacaactaagaacatgaataatttggaaaccttaacatcatattggaggatatttgtcctttgtgaacctgtggcccagtcctcaccttctgtaacacagctttaatacttctataaagtataacaaactatgtttttttatttttacatgctaattttcacacatttctccaaaattcacatagactttcgctaggttgtaatcagaaggcaaaaaaacaccaagtctcactggcttgcaacaacagttaattctcactcacattacaaacgggcaacctcaagtcagctgcaggctttgtctacagacctcatttcaggacccaggctgaaaaagcagctccagtttgagacatgcctttctcttttggcaacagaaaagagcaagagagttggtagaaacagacaatgactcttcaagcatctgctgagacttgctgaacatcatgtttgctcatatgcactggccaaagtaagtcaaacgcttcctattcctgctccaccatgaaggatttgctacaagtcttgggcaaaggacagagatacacaacttcttacaggagggagtttaaatattggagacgccagggtacacaactcattactttgggagggaatagactaacataaagggagaacattccacatttttagcacttttgtatttaaacgtagcttttaaaaaaaaacaaatgtttattaagcaccccttttgttccagacacttttctgggtgcttgttatgtactaatgaacaaaacagaaaaaaaaaattctctacctttatggagcttacccactaaactattaaaataaaataagcctaataaagaagttaatagtacagtgagatgctcttttcccctcttttttttaatattttattttttattattatactttaagttttagggtacatgtgcacattgtgcaggttagttacatacgtatacatgtgccatgctggtgcgctgcacccactaactcgtcatctagcattaggtatatctcccaatgctatccctcccccctccccccaatccacaacagtccccagagtgtgatgttccccttcctgtgtccatgtgatctcattgttcaattcccacctaggagtgagaatatgcggtgtttggttttttgttcttgagatagtttactgagaatgatgatttccaatttcatccatgtccctaaaaaggacatgaactcatcattttttatggttgcatagtattccatggtgtatatgtgccacattttcttaatgcagtctatcattgttggacatttgggttggttccaagtctttgctattgtgaataatgccgcaataaacatacgtgtgcatgtgtctttatagcagcatgatttataatcctttgggtatataaccagtaatgggatggctgggtcaaatggtatttctagttctagatccctgaggaatcaccatactgtcttccgcaatggttgaactagtttacagtccctccaacagtgtaaaagtgttcctatttctccacatcctctccagcacctgttgtttcctgactttttaatgattgccattctaactggtgggagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttcattagatcccatttgtcaattttgggttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctattttggttactgtagccttgtagtatagtttgaagtcaggtagtgtggtgcctccagctttgttcttttggcttaggattgacttgacgatgcgggctcttttttggttccatatgaactttaaagtagttttttccaattctgtgaagaaagtcattggtagcttgatggggatggcactgaacctgtaaattaccttgggcagtatggccattttcacgatattgattcttcctacccatgagcatggaatgttcttccatttgtttgtatcctcttttatttccttcagcagtggtttgtagttctccttgaagaggtccttcacatcccttgtaagttggattcctaggtattttattctctttgaagccattgtgaatgggagttcactcatgatttggctctctgtttgtctgttgttggtgtacaggaatgcttgtgatttttgcacattgatattgtatcctgagactttgctgaagttgcttatcagcttaaggagattttgggctgagacgatggggttttctagatatacaatcatgtcgtctgcaaacagagacaatttgacttcctcttttcctaattgaataccctttatttccttctcctgcctaattgccctggccagaacttccaacactatgttgaatgggagtggtgagagagggcatccctgtcttgtgccagttttcaaagggaatgcttccagtttgtgcccattcagtatgatattggctgtgggtttgtcatagatagctcttattattttgaaatacctcccatcaatacctaatttattgagagtttttagcatgaagtgttgtttaattttgtcaaaggccttttctgcatctattgagataatcatgtggtttttgtctttggctccgtttatatgctggattacatttattgatttgcttatatggaaccagccttgcatcccagggatgaagcccacttgatcatggtggataagctttttgatgtgctgctggattcgttttgccagtattttattgaggatttttgcatcaatgttcatcaaggatattggtctaaaattctctttcttggttatgtctctgcccggctttggtttcagaatgatgctggcctcataaaatgagttagggaggattccctctttttctattgattggaatagtttcagaaggaatgataccagttcctccttgtacctctggtagaatttggctgtgaatccatctggtcctggactctttttggttggtaagctattgattattgccacaatttcagatcctgttattggtctattcagagattcaacttcttcctggtttggtcttgggagagtgtatgtgtcaaggaatttatccatttcttctagattttctagtttatttgtgtagaggtgtttgtagtattctctgatggtagtttgtatttctgtgggatcggtggtgataacccctttatcattttttattgcctctatttgattcttctctctttttttctttattagtcttgcgagtggtctatcaattttgttgatcctttcaaaaaaccagctcctggattcattaattttttgaagggttttttgtgtctctctttccttcagttctgctctgattttagttatttcttgccttctgctagcttttgaatgtgtttgctcttgcttttctagttcttttaattgtgatgttagggtgtcaattttagctctttcctgctttctcttgtgggcatttagtgctataaatttccctctacacactgctttgaatgcctcccagagattctggtatgttgtgtctttgttctcgttggtttcaaagaacatctttatttctgccttcatttcgttaggtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttcgtttaaagtctgttttatcagagactaggattgcaacccctgcctttttttgttttccatttgcttggtagatcttcctccatccttttatgttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctggttattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctgagcatttgcttgtctgtaaagtattttatttctccttcacttatgaagcttagtttggctggatatgaaattctgggttgaaaattctttcctttaagaatgttgaatattggcccccactcttctggcttgcagggtttctgccgagagatccgctgttagtctgatgggcctccctttgagggtaacccgacctttctctctggctgcccttaacatttcttccttcatttcaactttggtgaatctgacaattatgtgtcttggagtttctcttctcgaggagtatctttgtggcattctctgtatttcctgaatctgaacgttggcctgccttgctagattggggaagttctcctggataatatcctgcacagtgttttccaacttggttccattctccccatcactttcaggtacaccaatcagacgtagatttggtcttttcagatagtcccatatttcttggaggctttgctcgtttctttttattcttttttctctaaacttcccttctcacttcatttcattcatttcatcttccattgctgataccctttcttcctgttgatggcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcatagtaatttgatcgtctgaagccttcttctctcagctcatcaaagtcattctccgtccagctttgttcagttgctggtgagaagctgcgttcctttggaggaagagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgccctgctgggggtgcctcccagttaggctgctcaggggtcaggggtcagggacccacttgaggaggcagtctgcccgttctcagatctccagctgcgtactaggagaaccactgctctcttcaaaactgtcagacagggacatttaagtctgcagaggttactgctgtctttttgtttgtctgtgccctgctgccataggtggagcctacagaggcaggcaggcctccttgagctgtggtggactccacccagttccagcttccagctgctttgtttacctaagcaagcctgggcaatggtgggcgcccctcccccagccttgctgccgccttgcagtttgatctcagactgctgtgctagcaatcagcaagactccgtgggcgtaggaccctccgagccaggtgcgggatataatctcgtggtgtgccgttttttaagcccgtcggaaaagcgcagtattggggtgggagtgacccaattttccagatgccgtccatcacccctttctttgattaggaaagggaactccctgaccccttgtgcttcccaagtgaggcaatgcctcgccctgcttcggctcgcgcacggtgcgcgcacccactaacctgcgcctactgtctggcactccctactgagatgaacccggtacctcagatggaaatgcagaaatcacccgtcttctgcgtcgctcacgctgggagctgtagaccggagctgttcctattcggccatcttggctcctcccctct

SEQ ID NO: 12527 - DNA, 6062 bp, Homo sapiens
atttcatttttatttatttttatttttttttttaattttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttgcagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtccaggaatgtatccatttcttctagattttctagtttatttgcgtagaggtgtttgtaggattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtattcttgttgactttctgtctcgttgatctgtctaatgttgacagtggggtgttaaagtcttccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatggatcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtgatgacaaaatctctcagcatttgcttgtctataaagtattttatttctccttcacttatgaagcttagtttggctggatatgaaattctgggttgaaaattcttttctttaagaatgttgaatattggcccccactctctcctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggagcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgctcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctccca

SEQ ID NO: 12528 - DNA, 5657 bp, Homo sapiens
ttttctttttttttttttttttattatactttaagttctagggtacatgtgcacaacgtgctggtttgttacagatgtatacatgtgccatgttggtgtgctgcacccaataactcgtcatttacattaggtatatctcctaatgctatccctccctctaactccaccccacaacaggccccggtgtgtgatgttccccttcctgtgtccaagtgttctcattgctcaattcccacctatgagtgagaacatgcagtgtttggttttttgtccttgcaatagtttgctgagaatgatggtttccagcttcatccatgtccctgcaaaggacaagaactcatccttttttatggctgcatagtattccatggtgcatatgttccacattttcttaatccagtctatcattgttggacatttgggttggttccacgtatttgctattgtgaatagtgctgcaatgaacatatgtgtgcatgtgtctttatagcagcatgatttataatcctttgggtatatacccagtaatgggatggctgggtcaaatggtatttctagttctagatccctgagggatcgccacactgtcttccacaatggttgaactagtttacagtcccaccaacagtgtaaaagtgttcctatttctccacatcctctccagcacctgttgtttcctgactttttaatgattgccattctaactggtatgagatggtatctcattgtggttttgatttgcttttctctgatggccagtgatgatgagcattttttcatgtgtctgttggtggcatgaatgtcttcttttaagaagtgtttgttcatatcctttgctcactttctgatggcgttgtttttttctcgtaagtttgtttgagttctttgtagattctggatattagccctttgtcagatgagtagattgcaaaaattttctcccattctgtaggctgcctgttcacgctgatggtagtttcttttgctgtgcagaagctctttagtttaattagatcccatttgtcaattttggcttttgttgccattgcttttggcgttttagacatgaagttcttgctcatgcctatgtcctgaatggtaatgcctaggttttcttctagggttttcatggttttaggtctgacatttaagtctttaatccatcttgaattaatttttatataaggcataaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgtttttgttactgtagccttgtagtatagtttgaagtcaggtagtgtgatgtctccagctttgttcttttggcttaggattgtcttggcaatgtgggctcttttttggttccatatgaactttaaagtagttttttttccaattctgtgaagaaagtcattggtagcttgatgggcatggcattgaatctgtaaattaccttgggcagtatggtcatttttcacaatattgattcttcctacccacgagcatggaatgttcttccatctgcttgtgtcctcttttatttcgttgagcagtagtttgtaattctccttgaagaggtccttcatatcccttgtaagttggattcttaggtaatttattcactttgaagcaattgtgaatgggagttcactcatgatttggctctctgtttgtctgttattggtgtataagaatgcttgtgatttttgcacattgattttgtatcctgagactttgctgaagatgcttatcagcttaaggagattttgggctgagacgatggggttctctaaatatacaatcatgtcatctgcaaacagggacaatttgacttcctcttttcctaattgaatactctttatttctttctcctgtctgattgccctggccagaacttccaacactatgttaaataggagtggtgagagagggcatccctgtcttgtgccagttttcaaaaggaatgcttccagtttttgcccattcagtatgatattggctgtgggtttgtcataaatagctcttattattctgagatacgtcccatcaatacctaatctattgggagtttttagcatgaaggactgttgaattttgtcaaaggccttttctgtatctattgagataatcatatggtggtttttgtctttgggtctgtttatatgctggattacgtttattgatttccgtatgttgaaccagcctcgcatcccagggatgaagcccacttgattgtggtggataagctttttgatgtgctgctggattcggtttgccagtatttcattgaggatttttgcattgatgttcatcagggattctggtctaaaattctcttttgttgttgtgtctctgccacgctttcatatcaggatgatgctggcctcataaaatgagttagggaggattctttctttttctatttattggaatagtttcagaaggaatggtaccacctcctccttgtacctctgctagaattcggctgtgaatccatctggtcctggactttttttggttggtaggctattaattattgcctcactttcagagcctgttattggtctattcagggattcaacttcttcctggtttagtcttgggagggtgtatgtgtccaggaatttatccatttcttctagattttctagtttatttgcatagacatgtttatagtattctctgatggtagtttgtatttctgtgggatcagtggtgacatcccttttatcattttctattgcatctatttgattcttctctcttttcttctttattagtcttgctagcggtctgtcaattttgttcaacttttcaaaaaaccagctcctggattcattgattttttgaagggttttttgtgtctctgtctccttcagttctgctctgatcttagttatttcttgtcttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcactggtttcaaagaacatctttatttctgccttcattttgttatgtacccagtagtcattcaggagcaggttgttcagtttccatgtagttgagcagttttgagtgagtttcttaaccctgagttctagtttgattgcactgtggtctgagagatagtttgttataatttctgttcttttacattagctgaggagtgctttacttccaactatgtggtcaattttggaataagtgtgatgtggtgctaagaagaatgtatattttgttgattgggggtggagagttctgtagatgtctattaggtccacttggtgcagagctgagttcaattcccggatatccttgttaactttctgtttcgttgatctgtctaatgttgacagtggggtgctaaagtctcccattattattgtgtgggagtctaagtctctctgtaggtctctaaggacttgctttatgaatctgggtactcctgtattgggtgcatatatatttaggatagttagctcttcttgttgaattgatccctttaccactatgtaatggccttctttgtcaattttgatctttgttggtttaaagtctattttatcagagactaggatcgcaacccctgcctttttttgttttccatttgcttggtagatcttccttcatccgtttattttgagcctatgtgtgtctctccacctgagatgggtctcctgaatagagcacactgatggctcttgactctttatccaatttgccagtctgtgtcttttaattggagcatttagcccatttacatttaaggttaatattgttatgtatgaatttgatactgtcatgatgttagctggttattttgctcattagttgatgcagttgcttcctagcatcgaagatctttacagtttggcatgtttttgcagtggctggtaccagttgttcctttccatgtttaatgctttcttcaggagctcttgcagagcaggcctggtggtgacaaaatctttcagcatttgcttgtctgtaaaggattttatttctccttcactaacgaagcttgatttggctggatatgaaattctgggttgaaaattcttttctttaagaatgttgaatattggccaccactctcttctggcttgtagagtttctgccaagagatccactgttattctgatgggcttccctttgtggataacccgacctttctctctgactgcccttaacattttttctttcatttcaactttggtgaatctgacaattatgtatcttggagttgctcttctcgggaatatctttgtggcattctctgtatttcctgatttgaatgttggcctgccttgctaggttggggaagtactcctggataatatcctgcagagtgttttccagcttggttcaattctctccgtcactttcaggtacaccaatcagacgtagatttggtcttttcacatagtcccatatttcttggaggctttgttcatttctttttcctcttttttctctaaacttctcttcttgtttcattttattcatttgatcttcaatcactgataccctttcttccagttgatcgaatcggctactgaagcttgtgcattcatcatgtagttctcacgccatggttttcagctccatctggtcatttaaggacttctctacactggttattctagttagccattcatctaatcttttttcaaggtttttagcttctttgtgatggtttcgaacttcctcctttagctcggagaggtttgatagactgaagtcttctctcaactcgtcaaagtcattctccatccagctttgttctgttgctggtgaggagctgcattcctttggagggggagaggtgctctgatttttagaattttcagcttttctgctctgttttttccccatctttgtggttttatctacctttggtctttgatgatggtgacgtacagatggggttttggtgtggatgtcctttttgtttgttagttttccttctaacagtcaggatcctcagctgcagatctgttggagtttgctggaggtccactccagacactgtttgcctgggtaccagcagtggaggctgcagaacagcaaatattgctgaacatcaaatgttgctgcctgatcgttcctctggaagcttcgtctcagaggggtacccggccatgtgaggtgtcagtctgcccctactggagggtgcctcccagttaggctacttgggggtcagggaccacttgaggaggcagtctgactgttttcagatctcaaactccgtgctgggagaaccactactctcctcaaagctgtcagacagggacatttaagtctgcagaggtttctgctcccttttgtttggctatgccctgcccccagaggtggagtctacagaggcaggcagtcctccttgagctgcggcgggctccacccag

SEQ ID NO: 12529 - DNA, 6050 bp, Homo sapiens
tttctatcattttttttcttcctttttttttcccctttattattatactttaagttttagggtacatgtgcacattgtgcaggttagttacataggtatacatgtgccatgctgatgcgctgcacccactaacttgtcacctagcattaggtatatctcccagtgctatccctcccccctccccccaccacacaacagtccccagagtgtgatgttccccttcctgtgtccatgtgatctcattgttcaattcccacctatgagtgagaatatgcggtgtttggttttttgttcttgcgataatttactgaaaatgatgatttccaatttcatccatgtccctacaaaggacatgaactcatcatttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaacgagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgtttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccaattttcccagcaccatttattaaatagggaatcctttccccattgcttgtttttctcaggtttgtcaaagatcagatagttgtagatatgcggcattatttctgaggtctctgttctgttccattgatctatatctctgttttggtaccagtaccatgctgttttggttactgtaggcttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaactaccttgggtagtatggccattttcacgatattgattcttcctacccatgagcatggaatgttcttccatttgtttgtatcctcttttatttccttgagcagtggtttgtagttctccttgaagaggtccttcacatcccgtgtaagttggattcctaggtattttattctctttgaagcaattgtgaatgggagttcactcatgatttggctctctgtttggctgttattggtgtataagaatgcttgtgatttttgtacaatgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttgcccattcagtatgacattggctgtggttttgtcataaatagcccttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgattttcgtatgttgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtgtctgccaggctttggtatcagaatgatgctggcctcataaaatgagttagggaggattccctctttttctattgattggaatagtttcagaaggaatggtaccagttcctccttgtacctctggtagaattcggctgtgaatccgtctggtcctggactctttttggttggtaagctattgattattgccacaatttcagatcctgttattggtctattcagagattcaacttcttcctggtttagtcttgggagaatgtatgtgtcgaggaatttatccatttcttctagattttctagtttatttgcgtagaggtgtttgtagtattctctgatggtagtttgtatttctgtgggatcggtggtgatatcccctttatcattttttattgcatgtatttgattcttctctctttttttctttattagtcttgctagctagtggtctatctattttctgatcctttcaaaaaaccagctcctggattcattaattttttgaagggttttttctgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttcagtgagattcttaatcctgagttctagtttgattgcactgtggtctgagagatagtttgttataatttctgttcttttccatttgctgaggagagctttacttccaagtttgtggtcaattttggaataggtgtggtgtggtgctgaaaaaaatgtatattctgttgatttggggtggagagttctgttgatgtctattaggtccacttggtgccgagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctcggtgctcctgtgttgggtgcatatatatttaggatagttagctcttcttgttgaattgatccctttaccattatgtaatggccttctttgtctcttttgatctttgttggtttaaagtctgttttatcagagactaggatggcaacccctgcctttttttgttttccatttgcttggtagattttcctccatccttttattttgagcctatgtgtgtctctgcatgtgagatgggtttcctgaatacagcacactgatgggtcttgactctttatccaatttgccagtctgtgtcttttaattggaggacttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttcctccaggagctcttttagggcaggcctggtggtgacaaaatctctcagcatttgcttgtctgtaaagtattttatttctccttcacttatgaagcttagtttggctggatatgaaattctgggttgaaaattcttttctttcagaatgttgaatattggcccccactctcttctggcttgtagggtttctgccgagagatccactgttagtctgatgggcttccctttgagggtaacccgacctttctctctagctgcccttaatattttttctttcatttcaaccttggggaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtatttggtcttttcacatagtcccatatttcctggaggctttgctcatttctttttattcttttttctctaaacttcccttcttgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctatttatacattcttctaaatttttttcaaagttttcaacttctttgcctttggtttgaatgtcctcccatagctcagagcaatttcatcgtctgaagccttcttctctcagcctgtcaaagtcattctccgtccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcagggcttttggagtaccctgccgtgtgaggtgtcagtgtgcccctgttggggggtgcctcccagttaggctgctcgggggtcaggggtcaggcacccgcttgaggaggcagtctgcccgttctcagatctccagctgcgtgctgggagaaccactgctctcttcaaagctgtcagacagggacatttaagtctgcagaggttgctgctgtctttttgtttgtctgtgccctgcccccagaggtggagcctacagaggcaggcaggcctccttgagctgtggtgggctccacccagttcgagcttcctggctgctttgtttacctcagcaagcctgggcaatggcgggcgcccctcgcccagcctcgctgccgccttgctgtttgatctcagactgctgtgctcgcaatcagcgagactccatgggcgtaggaccctccgagccaggtgcggggtataatctcgtggtgcgccgttttttaagcccgtgggaaaagcgcagtattcgggtgggagtgacccgattttccaggtgccgtctgtgacccctttctttgactcggaaagggagctccctgaccccttgcgcttcccaagtgaggcgatgcctcgccctgcttcggctcgcgcacggtgcgtgcacccactgacctgcgcccactgtctggcactccctagtgagatgaacccggtacctcagatggaaatgcagaaatcacgctgcatcgctcacgctgggagctgtagaccggagctgttcctattcggccatcttggctccaca

SEQ ID NO: 12530 - DNA, 6033 bp, Homo sapiens
atataaatcttttctttttattatactttaagttttagggtacatgtgcacattgtgcaggttagttacatatgtatacatgtgccatgctggtgcgctgcacccactaactcgtcatctaacattaggtatatctcccaatgctatccctcccccctccccccaccccacaacagtccccagagtctgatgttccccttcctgtgtccatgtgttctcattgttcaattcccacctatgagtgagaatatgcggtgtttggttttttgttcttgcgatagtttaccgagaatgatgatttccaatttcatccatgtccctacaaaggacatgaactcatcattttttatggctgcatagtattccatggtgtatatgtgccacattttcttaatccagtctatcattgttggacatttggattggttccaagtttttgctattgtgaataatgccacaataaatatacatgtgcatgtgtctttatagcagcatgatttatagtcctttgagtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgcttcctgactttttaatgattgccattccaactggtgtgatatgatatctcattgtggttttgatttgcatgtctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatgtctgttttggtaccagtaccatgctgttttggttactgtagccttgtagtatagtttgaagtcaggtagtgtgatgcctccagctttgttcttttggcttaggattgacttggcgatgcgggctcttttttggcttcatgtaaactttaaagtagttttttccaattctgtgaagaaagtcattggtagcttgatggggatgacattgaatctgtaaattaccttgggcagtatggccattttcacgatattgattgttcctacccatgagcatggaatgttcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggccctctgtctgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcagagatagtcttattattttgaaatacgtcccatcaatacctaatttattgagagtttttagcatgaagggttgttgaattttgtcaaagggcttttctgcatctattgagataatcatgtggtttttgcctttggttctgtttatatgctggattacatttattgatttgcatatattgaaccagccttgcatcccagagatgaagcccacttgatcatggtggataggctttttgatgtgctgctggatttggtttgccagtattttattgaggatttttgcatcaatgttcaccaaggatattggtctaaaattctcttttttggttgtgtctttgcccggctttggtatcagaatgatgctggcctcataaaatgagggaggattccctctttttctgttgattggaatagtttcaatcaaatttcaagaaggaatggtaccagttcctccttgtacctctggtagaattcggctgtgaatccatctggtcctggactctttttcgttggtaagctattgattattgccacaatttgagatcctgttattggtctattcagagattcaacttcttccttgtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattaattaattttttgaatggttttttgtgtctctatttccttcagttctgctctgattttagttatttcttgccttctgctagcttttgaatgtgtttgctcttgcttttctagttcttttaattgtgatgttaggtgtcaattttggatctttcctgctttctcttgtgggcatttagtgctataaatttccctctacacgctgctttgaatgcgtcccagagattctggtatgttatgtctttgttcttgttggtttcaaagaacatctttatttctgccttcatttcgttatgtacctagtagtcattcaggaggaggttgttcagtttccatgtagttgagcagttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtataatctgttgatttggggtagagagttctgtagatgtctattaggtccacttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatctgggtgctcctgtattgggtgtctatatatttaggatagttagctcttcttgttgaattgatccctttaccattatgtaatggccttctttgtctcttttgatctttgttggtttaaagtctgttttatcagagacgaggattgcaacccctgcctttttttgttttccatttgcttggtagatcttcctccatccttttattttgagcctatgtgtgtctgtgcatgtgagatgggtttcctgaatacagcacactgatgggtcttgactctttatccaatttgccagtctgtgccttttaattggagcatttagtccatttacatttaaagttagtattgttatgtgtgaatttgatcctgtcattatgatgttagctggttattttgctcattagttgaggcagtttcttcctagtctcaatggtctttacattttggcatgattttgcagtggctggtacttgttgttcctttccatgtttagtgcttcctttaggagctcttttagggcaggcctggttgtgacaaaatctctcagcatttgcttgtctgtaaagtattttatttctccttcacttatgaagcttagtttggctggatatgaaattctgggttgaaaattcttttctttaagaatgttgaatattggccccactctcttctggcttgtagagtttctgccgagagatctgcgttagtctgatgggcttccctttgagggtaacccgacctttctctctggctgcccttaacattttttccttcatttcatctttggtgaatctgacaattatgtgtcttggagttgctcttctcgaggattatctttgtggcgttctctgtatttcctgaatctgaatgttggcctgccttgctagattggggaagttctcctggataatatcctgcagagtgttttccaacttggttccattctccccatcactttcaggtacaccaatcagacatagatttggtcttttcacgtagtcccatatttcttggaggctttgctcatttctttttattcttttttctctaaccttcccttctcacttcatttcattcatttcatcttccatcactgataccctttcttccagttgattgcatcggctcctgaggcttctgcattcttcacgtagttctcgagccttggttttcagctccatcagctcctttaagcacttttctgtattggttattctagttataaattcttctaaatttttttcacagttttccacttctttgcctttggtttgcatgtcctcccgtagctcggagtaatttgatcgtgtaaagccttcttctcttagctcgtcaaagtcattctccgtccagctttgttccattgctggtgaggaactgcattcctttggaggaggagaggcgctctgctttttagagtttcgtttttctgttctgttttttccccatctttgtggttttatctacttttggtctttgatggcggtgatgtacagatgggtttttggtgtggatgtcctttctgtttgttagttttccttctaacagacaggaccctcagctgcaggtctgttggagtacccggccatgtgagctgtaagtctgcccctgctggggggtgcctcccagttaggctgcttgggggtcagggatcagggacccacttgaggcagtctgccagttctcagatctccagctgcatgctgggagaaccactgctctctccaaagctgtcagacagggacatttaagtctgcagaggttactgctgtctttttgtttgtctgtgccctgcccccagaggtggagcctacagaggcaggcaagcctccttgagctgtggtgggctccacccagttcgagcttcccagctgctttgtttacctaagcaagcctgggcaatggcgggcgcccctcccccagccttgctgccgccttgcagtttgatctcagactgctgtgctagcaatcagcgagactccgtgggcataggaccctctgagccaggtgcgggatataatctcctggtgcgccattttttaagcccatcggaaaagcgcaatattcaggtgggagtgacccgattttccaggtgccgtctgtcaccccttttttgactaggaaagggaactccctgaccccttgcgcttcctgagtgaggcaatgcctcaccctgcttcggctcgcacacggtgtgcgcacccactgacctgggcccactttctggcactcgctagtgagatgaacctggtacctcagatggaaatgcagaaatcacctgtcttctgcgtcgctcacgctgggacctgtagaccggagctgttcctattcggccatcttggctcccg

SEQ ID NO: 12531 - DNA, 5029 bp, Homo sapiens
gctgttttctttttgtttattattataatttaagtttgagggtacatgtgcacaatgtgcaggtttgttacatatgtatacatgtgccatgttggtgtgctgcacccattaactcgtcatttagcattaggtatatctcctaatgctctccctacccgctacccccaccccacaacaggccccaagtgtgtgatgttccccttcctgtgtccatgtgttctcattgttcatttcccacctatgagtaagaacatgcggtgtttggttttttctccttgcgatggtttgctgagaatgatggtttccagcttcatccatgtccctacaaaggacatgaactcatcattttttaaggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttggatatacatccagtaatgggatggctgggtcaaacgatatttctagttctagatccctgaggaatcgccacactgacttccacaattgttgaactagtttacagtcccaccaacagtgtaaaattgttcctatttctccacatcctcttcagcacctgttgtttcctgacttcttaatgatcgccattctaactggtgtgagatggtatctcattgtggttttgatttgcatttctctgatggccagtgatgatgagcattttttcatgtgtcttttggctgcataaatgtcttcttttgagaagcgtctgttcatatccttcgcccacttgttgatggggttgtttttttcttgtaaatttgtttgagttctttgtagattctggatattagccctttgtcagatgagcagattgcaaaaattttgtcccattctgtaggttgcctattcactctgatgatagtttcttttgctgtgcagaagctctttagtttaattagttcccatttgtcagttttggcttttgttgccattgctttgggtgttttagacatgaagtccttgcccttgcccatgcctatgtcctgaatggtattgcctaggttttcttctagggtttttatggttttaggtctaacatttaaatctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagataacgtggcattatttctgagggctctgttctgttccattggtctagatctctgttttggtaccagtaccatgctgtttgggttactgttgccttgtagtatagtttgaagtcaggtagtgtgatgcctccagctttgttcttttggcttaggattgacttggcgatgcgggctcttttttggttccatatgaactttaaagtagttttctccaattctgtgaagaaagtcattggtagcttgatggggatggcattgaatctataaattaccttgggcagtatggccattttcacgatattgattgttcctacccatgagcatggaatgttcttccatttgtttgtatcctcttttattttcattgagcagtggtttgtagttctccttaaagaggtccttcacatcccttgtaagttggatcctaggtattttattctctgaagcaattgtgaatgggagttcactcatgatttggctctctgtttgtctgctaatggtataagaatgcttgtgatttttgcacattgattttgtatcctgagactttgctgaagttgcctatcagcttaaggagattttgggctgagacgatgggttttctagatatactatcacatcatctgcaaacaggaacaatttgatttcctcttttcctaactgaataccctttatttccttctcctgcctgattgccctggccagaacttccaacactatgttgaataggagtggtgagagagggcatccctatcatgtgccagttttcaaagggaatgcttccagtttttgcccattcagtatgatattggctgtgggtttgtcatagatagctcttattattttgagatatgtcccatcaatacctaatttattgagagtttttagcatgaagtgctgttgaattttgtcaaaggccttttctgcatctattgagataatcatgtggtttttgtcattggttctgtttatatactggattatgtttaatgatttgcatatgttgaaccagccttgcatcccagggatgaagcccacttgatcatggtggataagctttttgatgtgctgctggattcggtttgccagtattatattgaggatttttgcattgatgttcatcagggatcttggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatctgtctggtcccggactttttttggttggtaagctattaattattgcctcaatttcagagcctgttatcggtctattcagagattcaacttcttcctggtttagtcttgggagggtgtatgtgtcaaggaatttatccatttcttctagattttctagtttatttgcgtagaggtgtttatactattctctgatggtagtttgtatttctgtaggatcagtggtgatatcccctttatcattttttaattgcatctatttgattcttctctgttttcttctttattagtcttgctagtggtctatcaattttgttgatcttttcacaaaaccagctcctggattcattgattttttgaagggttttttgtgtctctatttccttcagttctgctctgatcttagttatttcttgccttctgctagcttttaaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttcattatgtacccagtagtcactcaggagcaggttgttcagtttccgtgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtctattctgttgatttggggtggagagttctgtagatgtctattaggtctgcttggtgcagaactgaattcaatttctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgcattgatccctttaccatcatgtaatggccttctttgtcacttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcactttcttcctagcctcgctggtctttacaatttggcatgtttttgcagtgggtggtaccagttgttcctttccatgtttagtgcttccttcaggagctcttttagggcaggcctggtggtgagaaaatctctcagcatttgcttatctataaagtattttatttctccttcacttatgaagcttagtttcactggataagaaattctgggttgaaaattcttttctttaagaatgttgaatattggcccccactctcttctgccttctagagtttctgccgagagatccattgttagtctgataggcttccctttatgggtaacccgacctttctctctggctgcccttaacattttttcctgcatttcaactttggtgaatctgacaattctgtgtcttggagttgctcttcttgaggagtatctttgtggcgttctctgtatttcctgaatctgaatgttggcctgccttgctagattagggaagttctcctggataatatcctgcagagtgttttccaacttggtcccattctccctgtcactttcaggtacaccaatcagacatagatttggtcttttcacaaagtcccatatttcttggaggctttgttcatttctttttattcttttttctctaaacttctcttctcacttcatttcattcgtttgatcttccatcactgataccctttcttccagttgatcgaattggctactgaggcttgtgcattcgtcacgtagttctcgtgccttggttttcagctccatcaggtcctttaaggacttctttgcattggttattctagttagccatttgtctaatcttttttcaaggtttttaacttctttgccatgggttcgaacttcctcctttagcttggagtagtttgattgtctgaagccttctctcagctcgtcagagtcattctccat

SEQ ID NO: 12532 - DNA, 6044 bp, Homo sapiens
attgctgtttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtctctacaaaggatatgaactcatcattttttatggctgcatagtattccatggtgtatatgtgccacgttttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatttgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgaagaggtgtttgtagtattctctgatggtagtttgtatttctgtgggatcggtggtgatatcccctttatcattttttattgtgtctatttgattcttctctcttctttctttattagtcttgctagcggtctatcaattttgttgatcctttcaaaaaaccagctcctggattcattgattttttgaagggttttttgtgcctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaacaggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagactctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgatacccttacttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttcctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgaccgtcacccctttctttgactcggaaagggaactccctgaccccttgcgcttcccaggtgaggcaatgcctcgctctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccctc

SEQ ID NO: 12533 - DNA, 4732 bp, Homo sapiens
tctctttttttattattattattgtactttaagtttttagggtacatgtgcacaacgtgcagatttgttacatatgtatacatatgccatgttggtgtgctgcacccattaacttgtcatttaacattcggtatatctcctaatgctatccgtccccgctccccccacccaacaacaggccccagtgtgtgatgttccccttcctgtgtccatgtgttctcattgttcaattcccacctatgagtaagaacatgcggtgtttggttttttgtccttgcaatagtttgctgagaatgatggtttctagcttcatccatgtccctacaaaggacatgaactcatcatttttatggctgcacagtattccatggtgtatatgtgccacattttcttaatccagtctatcattgttggacatttgggttggttccaagtctttgctattgtgaatagtgccgcaataaacatatgtgtgcatgtgtctttatagcagcatgatttataatcctttgggcatatacccagtaatgggatagctgggtcaaatggtatttctagttccagatccctgaggaatcgccacactgacttccataatggttgaactagtttacagacccaacaacaatgtaaaagtgttcctatttctccacatcctctccagcacctgttgtttcctgactttttaataatcgccattctaactggtgtgagatggtatctcattgtggttttgatttgcatttctctaatggccagtgatgatgaacatttttccatgtgtcttttggctgcataaatgccttcttttgagaagtgtctgttcatatcctttgcgcactttttgatggggttgtttgtttttttcttgtaaatttgttggagttcattgtagattctggttattagccctttgtcagatgagtagattgcaaaaattttctcccattctgtaggttgcctgttcactctgatggtggtttcttctgctgtgcagaagctctttagttcaattagatcccatttgtcaattttggcttttgttgccattgcttttggtgttttagacatgaagtccttgcccatgcctatgtcctgaatggtattacctaggttttcttctagggtttttatggttttaggtctaacatttaagtctttaatccatagtaaattaatttttgtataaggtgtaaggaagggatccagtttcagctttctatatatggctagccagttttcccagcaccatttattaaatagggaatcctttccccattgcttgtttttgtcaggtttgtcaaagatcagatagttgtacatatgcagcattatttctgagggctctgttctgttccattggtctacatctctgttttggtacaagtaccatgctgttttggttactgtagccttgtagtgtagtttgaagtcaggtagcgtgatgcctccagctttgttcttttggcttaggattgacttggcaatgcgggctcttttttggttccatatgaactttaaagtagttttttccaattatctgaagaaagtcattagtagcttgatggggatggcattgaatctataaattaccttgggcagtatggccatcttcacaatattgattcttcctacccatgagcatggaatgttcttccgtttgtttgtatcctcttttatttcattgagcagtggtttgtagttctccttgcagaggtccttcacatcccttgtaagttggattcctaggtattttattctctttgaagcaattgtgagtgggagttcactcacgatttggctctctgtttgtctgttattggtgtataggaatgcttgtgatttttgcacattgattttgtatcctgagactttgctgaagttgcctatcagcttaaggagattttaggttgagacaatggggttttctagatatacaatcatgtcagctgcaaacagggacaatttgacttcctcttttcctaattgaatgccctttatttccttctcctgcctaattgccctggccagaacttccaacactatgttgaatatttgtggtgagagagggcatccctgttttttgccagttttcaaagggaatgcttccagtttttgcccattgagtatgatattggctgtgggtttgtcatagatagctcttattattttgagatatgtcccatcaatatctaatttattgagagtttttatcataaagagttgttgaattttgtcaaaggccttttctgcatctattgagatagccgtgtggtttttgtcattagttctgtctatatgctggattaggtttattgattttcctatgttgaaccagccttgcatcccagggatgaagcccacttgatcatggtggataagctttttgatgtgctgctggattcagtttgccagtattttattgaggatttttgcatcgatgttcatcaggtatattggtctaaaattctctttttttgttgtgtctctgccagactttggtatcaggatgatgctggcctcataaaatgagttagggaggattccctctttttctattgattagaatagtttcagaaggaatagtaccagctcctccttgtacctctggtagaattcagctgtgaatccatctggtcctggactttttttggttggtaagctattaattattgcctcaatttcagagcctattattggtctattcagagattcaacttcttcctggtttagtcttgtgagagtgtatgtgtcgaggaatttatccatttcttctagattttctagtttatttgcatagacgtgtttatagtattctctgatggtagtttgtgtttctgtgggatcgttggtgatatcccctttatcattttttattgcatctatttgattcttctctcttttcttctttattagtcttgtttgctagtggtctatcaattttgttgatcttttcaaaaaaccagcttctggatttattgattttttgaagggttttttgtgtctctatttccttcagttctgctctgatcttagttatttcttgccttctgctagcttttgaatgtgtttgctcttgcttctctagttattttaattgtgatgttagggtgtcagttttagatctttcctactttctcttgtgggcatttagtgctataaatttccctctacacactgttttgaatgtgtcccagagattttggaatgttttgtctttgttttcattggtttcaaagaacatctttatttctgccttcatttcattatgtacccagtagtcattcaggagcaggttgttcagtttctatgtagttgagcggttttgagtgagtttcttaatcctgtggtctagtttgattgcactgtggtctgagagacagtttgttataatttttgttcttttacatttgctaaggagtgctttacttccaactatgtggccaattttggaataggtgtggtgtggtgctgagaagaatgtatattctgttgatttggggtggagagttctgtagatgtctattaggtctgcttggtgcagagctgagttcaattcctggatatccttgttaactttctgtctcttgatctgtctaatgttgacagtggggtgttaaagtctcccattattatagtgcgggagtctaagtctatttgtaggcctctaaggacttgctttatgaatctgggtgctcctgtattaggtgcatatatatttaggatagttagctcttcttgttgaattgatccctttaccattatgtaatggccttctttttctcttttgatctttgttggtttaaagtctgttttatcagagactagagttgcaacccctgcctttttttgttttccatttgcttggtagatcttcctccatccctttattttgagcctatgtgtgtctctgcacgtgagatgggtttcctgaatacagcacagtgataggtcttgactctttatccaatttgccagtctgtgtcttttaattggagcatttagcccatttacatttaaggttaatattgttatgtatcaatttgatcctgtcatgatggtgttagctggcaattttgctcattagttgatgcagtttcttcctaacctcgatggtctttacaactcggcatgtttttccagtggctggtactggcttttcctttccatatttagtgcttccttcaggagctcttttaggtcaggcctggtggtgacaaaatctctcagcatttgcttgtctgtaaagtgttttatttctccttcacttatgaagcttagtttggctggatatgaaattctgggttgaaaattcttttctttaagaatgttgaatattggcccccactctcttctggcttgtagagtttctgccaagagatccgctgttagtctaatgggcttccctttgtgggttacccgacctttctctctggctgcccttaccattttttccttcatttcaactttggtgaatctgacaattatgtgtcttggagttgctcttctcaaggagtatctttgtggtgttctctgtatttcctgaatttcaatattggcctgccttgctagattggggacattctcctggataatatcctgcagagtgttttccatcttggttccattctccccatcactttcaggtacaccagtcagatgtagatttggtcttttcacatagtctggtcttttcacatagtcccatatttcttggaggctttgttttttt

SEQ ID NO: 12534 - DNA, 4830 bp, Homo sapiens
acttttttttaaaattatactttaagttctagggtacatgtgcacaatgtgcagatttgttacatagatatacatgtgccatgttggtttgctgcacccatcaactcgtcatttacattaggtatttctcctaatgctatccctccccttgcccccaaccccacaacaggccccagggtgtgatgttccctgccctgtatccaagtgttctcattgttcaactcccacctgtgagtgagaacatgcggtgtttggttttctgtccttgtgatagtttgctcagcatgatggtttccagcttcatccatgtccccacaaaggacatgaactcatccttttttatggctgcatagtattccatggtgtatacatgccacattttcttaatccagtctatcattgatggacctttgggttggttccaagtctttgctattgtgaatactgccacaataagcatacgtgtgcatgtgtctttatagcagcatgatttataatcctttgggtatatacccagtaatgggatggctgagtcaaatggtatttctagttctagatccttgaggaattgccatactgtcttccacaatggttgaactagtttacactcccacccacagtgtaaaagcattcctgtttctccacatcctctccagcatctgttgtttcctgactttttaatgatcgccattctaactggtgtgagatggtatctcattatggttttgatttgcatttctctgatgaccagtgatgatgagcattttttcatgtgcctgttggctgcataaatgtcttcttttgagaagtgtttgtttatatcttttgcccactttttgatggggttgtttgtttttttcttgtaaatttgtttacattctttgtggattctggatattagccctttgtcagatggataggttacaaaaattttctcccattctttaggttggctgttcactctgatggtcgtttcttttgctgtgcagaagctctttagtttaattagatcccatttgtctattttggcttttgttgccattgcttttggtgttttagtcatgaagtccttgcccatgcctatgtcctgaatggtattgtttaggttttcttccagggtttttatggttttaggtctaacatttaagtctttaatccaccttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgaggcctctgttctgttctattcgtctatatatctgttttggtaccagtaccatgctgtttcggttactgtagccttatagtatagtttgaagtcaagtagcatgatgcctccagctttgttcttttggattaggattgtcttggcaatgcaggctcttttttggttgcatatgaactttaaagtagttttttccaattctgtgaagaatgtcattggtagcttgatggggatggcattgaatctataaattaccttgggcagtatggccctttccacagtattgattcttcctaaccatgagcatggaatgttcttccatttgtttgtgtcctcttttattttgttgagcagtggtttgtagttcttgttgaagaggaccttcacatcccttgtaagttggatgcctaggtattttattctctttgtagcaattgtgaatgagagttcactcatgatttggctctctgtttgtctgttattggtgtataggaatgcttgtgatgtttgcacattgattttgtatcctgagactttgctgaagttgcttatcagcttgaggagattttgagctgagatgatgggtttttctaaatatacaatcatgtcatctgcaaacagggacagttcgacttcctcttttcctaattgaataccctttatttctttctcttgcctgattgccctggccagaacttccaacactatgttgaataggagtggtaagagagggcatccctgtcttgtgctagttttcaaagggaatgcttcagtttttgcccattcagtatgatattggctgtgggtttgtcataaatagcttttattattttgagatacattccatcaatacctagttcattgagagtttttagcatgaagggctgttgtattttgttgaaggtcttttctgcatctattgagataatcatgtggtttttgtcattgttctgtttatgtgatggattatgtttactgatttgcatatgttgaaccagccttgcattccagggatgaagctgacttaatcgtggtggataagctttttgatgcactgctggatttggtttgccagtattttattgaggatttttgcatcgatgttcatcagggatattggcctaaaattctctttttttgttttgtctctgctagactttggtatcaggatgatacttgcctcataaaatgaattagggaggataccctctttttgtattgattggaatagtttcagaaggattgatacaaagaggtttgtacctctgctagaatttggctgtgaatccgtctggtcctggactttttttggttggttaggctattagttattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccaatttatcgttttttattgcgtctatttgattcttctctcttttcttctttattagtcttgctagcggtttatcaattttgttgatcttttcaaaaaaaaaaacagctcctggattcattgatttttttgaagagttttttgtgtctctatctccttcagttctgctctgatcttagttatttcttgccttctgctagcttttgaatttgtttactcttgcttctctagttcttttaattgtgatgttagggtgttgattttagatcttttctgctttctcttgtgggcatttagtgctataaatttccctctacacatggctttaaatgtgtcccagacattctggtatgttgtgtctttgttctcgttggtttcaaagaacatctttatttctgccttcatttcgttatgtccccagtagtcattcaggagcaggttgttcagtttccatgtagttgtgcagttttgagtgagtttcttaatcccgagttctaatttgattgcactgtggtctgagagacagtttgttatgatttctcttcttttatgtttgctgaggagtgctttacttccaactatgtggtcagttttacaataagtgcgatgtggtgctgagacaaatgtatattctgttgatttggggtggagagttctgtagatgtctattaggtctgcttggtgcagagctgagttcaagtcctggatatccttgttaagtttctgtctcgttgatccgtctaatattgacagtggggtgttgaagtctcctattattattgtgtgggagtctaagtctctttgtaggtctctgaggacttgctttatgaatctggatgctcctgtattgggtgcatatttatttaggatagttagctcttcttgttcaatcgatccctttaccattatgtaatggccttctttatctcttttgatctttgttggtttaaagtctgttttatcagagactaggattgcaacccctgcttttttttgctttccatttgcttggtagatcttcctccatccctttattttgagcctatgtgtgtctctgcatgtgagatgggtctcctgaatacagcacactgatgggtcttgactctatccaatttgccagcctgtatctttcaactggggcatttagcccatttacatttaaggttaatattatgtgtgcatttgatcctgtcattatgatgttagctggctattttgcccattagctgatgtagtttattcctagcattgatggtttttacaatgtagcatgtttttgcagtggctggtaccagttattcctttccatgtttagtgcttccttcaggagctcttgtaaggcaggcctggtggtgacaaaatctctcagcatttgcttgtctgtaaaggattttatttctccttcacatatgaaggttagtttggctggatatgaaattctgggttgaaaattcttttctttaagaaagttgaatcttggcccctactctcttctggcttgtagagtttctgctgagagatctgctgttagtctgatgggcttccctttgtgggtaacctgatgtttctctctggctgcccttaatattttttccttcatttcaaccttggtgaatctgacaattatgtgtcttggggttgctcttctcgaggagtatctttgtggtgttctctgtatttcctgaatttgaatgttggcctgccttactaggttggggaagttctcctgggtaatatcctgaagagtgttttccaacttggatccattttccctgtcactttcaggtacaccaatgaaacgtagatttggtcttttcacatagtcccatatttcttggaggctttgtttgtttctttttactcttttttctctaaacttctctttttgttttatttcattgatttgatcttcaatcactgataccctttcttccacttgatcgcattggctattgaagcttgtgcatgcatctcgtagttct

SEQ ID NO: 12535 - DNA, 11028 bp, Homo sapiens
tttattttttgagatggagtctccctctgccacccaggcaggagtgcagtggcgtgatctcagctcactgcaagctccacctcctgggttcacgccattctcctgcctcagcctcccaagtagctgggactacaggcacccgccaccacgcccagctaatttttgcatttttagtacagacagggtttcaccatgttagccaggatggtctcaatctcctgaccttgtgatccgcccgcctaggcctcccaaagtgctgggattacaggcatgagccaccgcgcccagccttacataatagttatttttaaaatctgcttagtaatatttgcaaaataggtaattcaagcaaatcttcccactgaaaacaaatagaaaagttagacaaaataatttttacaagataacttgaagctatgagaaaaaaggaggctgtaaaaaaattataaaccaaaaatgtaggagaaaagggcagagagagacaaatctagcatttggggcaacttcaaatgtaagagggtgcatagatcctggaagagtagctaagcagctcagaacctaagaagtgcttttgaacaacttgtaaggtagaaagacaaaacttgaaatccaagattccagtgctttatattaggaacccaaaaagctgtaccttaagaacaaagataactcagtaatataccaaccctcaaaaaatgaagaaagttcaataatctcaagccctgaaattagattaagtttatcccaattgtttgtgctcccagccacttgtcagatgcaaaagtaaagcttcactgaagaaaaataacattatcttagtttattatctctagaattgtttatatacaatatcttgtgctcaaccaaaaataaacagacacaaaacagagacaaaaattgtgacaagacagacagcaaaagagagagagagaggagagagagagggaaagggaggagaagagaaagagagaaagaaagagagaaattagttaatagaaacaaagcaatcaaatatcaagataataaagttatcaaaactaaatgttgaatcagctaactagatagtggacttgttgaaaactatgccaaatattttcaaggaaatatatcaagattggaaatattttcctaaaaaactctcaggaatcacaaaagaagtgaatcagatcaaaattccaaaatcaaaaatacaataatcaaaattaagaatccaatggataaatttaagaacaaatttgtattaatctaaatactatattcagattaagttacaattgtgaaataataaaaaatatatataatggtctctgtccaaagtacttggcacagagttcctaaaactcttataatgtcctaagcaataggagtgctagaattatttcttctaatgtgtggtctctgttctggttcctgagagatagctcctgatacccttgtagaccagggtgctaggagaatcttctgttataacatttggcctttgccccttggttcccaacacagcgctccttccaatcccttggaatatcctgggtgataggagaatcttttcttctaatgaagcaattcttggtgggcttctggatagcctcaggataggggctggttgccaggggcaactcaccatgtgattaaaagcttggaacattcagacccacccctaacctctggagaggaaaaaggggctaaaggttgagtttatcactaatgcccagtgatgtaatcaaccatccatatgtaatgaagccttcatcaaaacctaaagtaacttgcttcagatgagctttgaaacagtggaacacatggaagttcctgggggatgggtattcagagagggtataggaactccacactccttctcatgtgccttgccctatgcacctcttccatctggctgttcatctttgtaatatcctttataataaactggtttaaatgtaaataaagtgtttcccagagaaggaggtcatgggaacccccaatttatagctggtcatcagatgcccaggttacaacctactatttgcaactagcacctgcagcgggggaggtcttgtgggattgagtcctcaacctatgggatctgatgctatctacaggtagatagtgtaagaattgagttgaataagagtataccagctattgtctgctgaagaatctactacagaatcaattggttgctggtagggagaaatccccacaaattttggtgaccagaggccacaaaagtattctaaatactttttttctttatttctcaatgcttttttttccctatatctcagagaagctgaagagagaattagtgatttggaagacaagtagatggggagagagtgttcaggataagcatatattaaaagcacaaaaaatacaaaaaagtaaaataacaaaacacttaaaagacacactaacaaggtctgacacacctggactcttagaataaggggacaaataatcagctaagaaaactctaaacctaatgaaaatgccatagcttatgagctcaagaagtatatatgaagaggaaacaataacaacttctgtttctacccaagatacagaaataggaaccagatttaccatcgtaccataaacaaatggaaagcaaaaaatatatatatgaaaattgattttcggaccctgagtaacaggcaatgtagggctataatcctggataacaagaaaacaaataagcaaggtaaaccttatgcttttaccagcttgtgtttagaggcaatttcaaagctgtagtaaagaaaggggaaccaaaatagagcctaatggtctcactaagtgaagggaacagaatgtgatttaaaatttttttttattttttcccttatgtttcatttaggattttctcaatgtctgattttcataatttttctttatatttatcttgtgtggagtttgctgaacctctcacatctcttgcctattatctcttcaattgttgcttaagtctcattctctttctcctttcttcctgggactttacttatatatactgtcatgcaacacttaacaaagggaatatatgttttgaaaatttcattattaggtaatttcatcattgtgtaaacatcatagagtatatttctgcaaacctaaatggaaagtgtacaatagcctattgcacacttaggctatatggtgtagcctattgctcctagcctacaaacttgtatagcattttactgtgctgagtactgcaggccattgtaatacaatagtatttttgtatctaaacatagaaaagatacagtgatagtgctatattataatcttctcagaccgccatcatatttctagtctattgaattcttcattcattcatatttttctatgttttggtaatttatattcacttgactttgagttcctcaatgttatctaggatgtacaatctaatgttaaaccattcccatgagttcttaaattagttattgcttttcttttcagatccataatattcacttgaaaattttttatagattgtatttatctgttgaaattgccatctttttatcaatattgtcatttttctgctttccttaacaaattttatattcattttatagtctttgctgctaattccagcatctggatcatctggggactggtctatatagttatctttaattatggatcatatttttcacctttttcatatgtctcatcattgttttatttatgccagaaagaacaatagagactggagtaaatgttatgttccttcataaagagcatcccttgtcctctattaagcaggtgggatgaatggctggctatttttgaactaattattaattgagctgggtgacagttcggttgctactttagtttgactctgtcacaatttaataaaatgtatgagaagtagcaaggaagaaatacagactgatagaattcacacatagaaaatcaaaaagaacttacagactggatacaaggtcgatatgcaaaaatcagtagtttttttatacatcgacaaacaaaaaatgaaattttaaatgatatcatctacaatagtatccaaatatattacatttctaggaattaatctaagaaaacatgtaaagcatctctattcagaacaatataacacattatggaaagaaataagcatccaaatcagggtccagccaactttttctgtaaggatcaagtaataagtattttagcctttgtagctagctggtctatatcataactgcccaattctgcattataatgccaacacagaaatagacaatgtgtaaaccaataggtgtgactgtgctcccataaaactttttttcaaaaacaggcagaggatacatatttatcctatagactatagtttgttgacccctgatctaaataatcacagaaataaaatatattaatatgtcataaatatacaataactgtgtccattctccccaaattgattttttaattcaaatccttcacagtcaaattcagatgtttgtggggttattttttgtttgtttgttttttgttttggtaaatattgacaagctaattccaacatacaataaaaattaaatgggcaaaaatttgccaagacaacactgaagaaaaacagaattaaaagacttcagagatgtcaagagttttttaacactctagtaattaacaaagcgtgctattgccaacagaatatatgcctagacaaataggacctaggaggcaatccagtaacgtctttgcatgtacaaatatttgattcatgagaaagctatcactgcaaagcagtggagaagggatggtcattccaataaccaatctagatgggtcatctagatagaaataatgtaaaagaagataccctcatataatacacaaaattaattatatgtatatgatagatctaaatgtgaaaaataaaacaatgagacttccaaaagaaactacagaggaatattttcagaactttgaggtaggcaaaaatttcttaaccagtacatataaaagactagtggcaaaagagaagacattaaaaagaaacacgtctaattatcaaagacattttgagtgaaaagggaagccatgggctgagagaagatgttttcagagacttagatagatattacataaaagaagatctccaggtgaaaagatgccaaggattataacacatcaggaaaaatgaaaatcaaaatcacaaaaagatatcaataagagttggagtggctaaaatagcaagaatgataatattaagtattggtgaaaatgtgggaggcctaagttggaagaacttaggtgggccgtaagttggaagactatattatatgctaaagttgaatatagacattggaagaactacattgcatgctaaagttaaatgtacacatttcctattaaccaatttcatttttaggtatagttcaaaaagaaatatatgcacatatacacaataatgttcacagtggcaccattcgtaataatccaataaatttgtgttatttcccataaaactgggaaacaacacaaattcttgacatcagtagaatggataaatcatttgtagaatattaattcaatatactattatgcaataatgaaaataaactactgtcccacatataatatggttatacctcagaaaaataatgcagagtaaaagaatttgccaaatatggaaaatatgtattatattgtttcatttttttaattttattattattatactttaagttttagggtacatgtgcacaacgtgcaagtttgttacatatgtatacatgtgccatgttggtgtgctgcacccattaactcgtcatttagcattaggtatatctcctaatgctatccctcccaacttcccccaccccacaacagtccccagtgtgtgatgttccccttctgtgtccatgtgttcttattgttcaattcccacctatgagtgagaacatgcggtgtttggtttttcgtccttgccatagtttgctgagaattatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagcaccgtgataaacatacgtgtgcatgtgtctttatagcagcatgatttataatcctttgggtatatacccagtaatgggatggctgggtcaaatggtatttctagttctagatccctgaggaatcgccacactgaattccacaatggttgaactagtttacagtcccaccaacagtataaaagtgttcctatttctccacatcctctccagcacctgttgtttcctgactttttaatgatcaccattctaactggtgtgagatggtgtctcattgtggtttcaatttgcatttctgtgatggccagtgatgatgagcattttttcatgtgttttttggctgcataaatgtcttcttttgagaagtgtctgttcatatccttcacccactttttgatggggttgtttctttttttcttgtaaatttgtttgagttcattgtaaattctggatattacccctttgtcagatgagtaggtggcaaaaattttctcccattctgtaggttgcctgttcactctgatggtagtttcttttgctgtgcagaagctctttagtttaatgagatcccatttgtcaattttggcttttgttgccattgcttttggtgttttagacatgaaggctttgcccatgcctatgtcctgaatggtactgcctaggttttcttctagggtttttatggttttaggtctaacatttaagcctttaatccatcttgaattaatctttgtataaggtgtaaggaagggatccagtttgagctttctacatgtggctagcctgttttcccagcaccatttattaaatagggaatcctttccccattgcttgcttttcaggtttgtcaaagatcagatagttgtagatatgtggcattatttctgagggctctgttctgttccactggtctatatctctgttttggtaccagtaccatgctgtttgggttaccataggcttgtagtatagtttgaagtcaggtagtgtgatgcctccagctttgttcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacgatattgattcttcctacccatgagcatagaatgttcttccatttgtttgtatcctcttttatttcattgagtagtggtttgttgttctccttgaagaggtccttcacatcccttgtaagttggattcctaggtattttattctctttgaagcaattgtgaatgggagttcactcatgatttggctctctgtttgtatgttattggtgtataagaatgcttgtgatttttgtacattgattttgtatcctgagactttgctgaagttgcttatcagcttaaggagattttgggctgagacgacggggttttctagatatacaatcatgtcatctgcaaacagggacaatttgacttcctcttttcctaattgaataccttttatttctttctcctgcctgattgccctggccagaacttccaacactatgttgaataggagtgttgagagagggcatccctgtcttgtgccagttttcaaagggaatgcttccagtttttgtctattcagtatgatattggctgtgggtttgtcatagatagctcttattattttgagatacgtcccatcaatacctaatttactgagagtttttagcatgaagcattgttgaattttgtcaaaggctttttctgcatctattgagataatcatgtggtttttgtctttggttctgtttatatgctggattacatttcttgatttgcgtatgttgaaccagtcttgcatcccagggatgaagcccagttgatcatggtggataagctttttgatgtgctgctggattcagtttgccagtattttattgagaatttttgcttcaatgttcatcaaggatattggtctaaaattctcttttttggttgtgtctctgccaggctttggtatcaggatgatgctggcctcataaaatgagttggggaggattctctctttttctattgattggaatagtttcagaatgaatggtaccagatcctccttgtacctctgttagaattcagctgtgaatccatctgctactggacattttttggttggtaagctgttaattattgcctcaatttcagagcctgttattggtctattcagagattcaacttcttcctggtttactcttgggagagtgtatgtgtcaaggaatttatccatttcttctaggttttctagtttatttgcatagaggtgtttatagtattctctgatggtagtttgtatttatgtgggatcagtggtgatatctcctttgtcactttttattgcatctatttgattcttctctcttttcttctttattagtcttgctagagggctatcaattttgttgatcttttcaaaaaaacagctcctggattcattgatttttttaaagggtttttttgtgtctctatttccttcagttcttctctgatcttagttatttcttgccttctgctagcttttgaatgtgtttgctcttgctactctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgcctttatttcgttatgtacccagtagttattcaggagcaggttgttcagtttccatgtagttgagcagtttggaggaagtttcttagtcctgagttctagtttgattgcactgtggtctgagagacagtttgttataatttctgttcttttacatttgctgaggagtgctttactctcaactatgtggtcaattttggaataggtgtggtgtggtgctgaaaagaatgtatattctgttgatttggggtggagagttctgtagatgtctattaggtcggcttggtgcagagctgagttcaattcctggatatccttgttaactctctgtctcgttgatttgtgtaatgttgacagtggggtgttaaagtctcccattattattgtgtgggtgtctaagtctctttgtaggtcactaaggacttgctttacgaatctgggtgctccagtattgggtgcatatatatttaggatagttagttcttcctgttgaattgatccctttaccattatgtaatggccttctttgtctcttttgattttgttggtttaaagtctgttttatctgagactaggattgcaacccctgccttttttttgttttccatttgcttagtagaccttcctccatccctttattgtgagcctacgtgtgtctctgcatgtgagatgggtttcctgaatacatcacactgatgggtcttgactctttatccaatttgccagtctgtgtcttttaattggagcatttagcccatttacatttaaggttagtattgttatgtgtgaatttgatcctgtcattatgatgttagctggttattttgctcgttagttgatgcagtttcttcctagccttgatggtctttacaatttggcatgtttttgcagtggctggtgccagtttttcctttccatgtttattgcttctttcaggagctcttttagggcaggcctggtggtgacaaaatctctcagcatttgcttgtctataaagtattttatttctccttcacttatgaagcttaatttggctggatatgaaattctggattgaaaattcttttctttaagaatgttgaatattggcccccattctcttctggcttgtagaatttctgctgagagatcagctgttagtctgatgggcttccctttgtgggtaacccgacctttctctctggctgcccttaacattttttccatcatttcaactttggtgaatctgacaattatgtgtcttggagttgctcttctcgaggagtatctttgtggtgttctctgtatttcctgaatctgaatgttggcctgccttgctagattggggaagttctcctgggtaatatcctgcagagtgttttccaacttggttccattctccctgtcgctttcagatacaccaatcagatgtagatttggtcttttcacatagtcccatatttcttggaggcttcgtttgtttcgttttattcttttttctctaaacttctcttctcacgtcatttcattcatttcatcttccatcgctgataccctttcttccagttgatcgcaacagctactgaggcttgtgcattcgtcacgtagttctcgtcccatggttttcagctccatcaggttctttaaggacttctctgcattggttattctagttagccatttgtctaatttttttttcaaggtttttaacttctttgccattggttcgaacttcctcctttagcttggagtagtttgatcttctgaagccttctctcagctcgtcaaagtcattctctgtccagctttgttctgttgctggtgaggagctgcattcctttggaggagaagaggcgctctgatttttagtgtttctggtttttctgctctgttttttccccatctttgtggttttatctacctttggtctttgaagatggtgatgtacagatgggtttttggtgcggatgtcctttctgtttattagttttccttctaacagtcaggaccctcagctgcaggtctgttggagttactggaggtccactccagaccctgtttgcctgggtatcagcagcagtggctgcagaacagcagatattggtgaaccacaaatgctgctgcctga

SEQ ID NO: 12536 - DNA, 6036 bp, Homo sapiens
ttaagttttctttatatcttctttttttttaattatactttaagttttagggtacatgtgcacattgtgcaggttagttacatatgtacacatgtgccatgctggtgcgctgcacccactaacttgtcatctagcattaggtatatctcccagtgctatccctccccccgccccccaccccacaacagtccccagagcgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcgcatgatttatagtcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcttgtccttcgcccactttttgatggggttgtttgtttttttcttgtaaatttgttgagttaattgtagattctggatattagccctttgtcagatgagtaggttgcgaaaattttctcccattttgtaggttgcctgttcactctgattgtagtttcttttgctgtacagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggtttaggattgacttggcgatgtgggctcttttttggttccatatgaactttaaagtagttttttccaatctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcgcatcccttgtaagttggattcctaggtattttattctctttgaagcaattgtgaatgggagttcactcatgatttggctctctgtttgtctgttgttggtgtataagaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgcgctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaggatgaaaggttgttgaattttgtcaaaggccttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcggtttgccagtattttattgaggatttttgcatcaatgttcgtcaaggttattggtctaaaattctcttttttggttgtgtctctgcccggctttggtatcagaatgatgctggcctcataaaatgagttagggaggattccctctttttctattgattggaatagtttcagaaggaatggtaccagttcctccttgtaccttgtggatccttgtgaatccatctggtcctggactctttttggttggtaaactattgattattgccacaatttcagctcctgttattggtctattcagagattcaacttcttcctggtttagtcttgggagagtgtatgtgtcgaggaatttatcgatttcttctagattttctagtttatttgcgtagaggtgtttgtagtattctctgatgatagtttgtatttctctgggatcagtggtgatatcccctttatcattttttattgtgtctatttgattcttctctctttttttctttattagtcttgctagcggtctatcaattttgttgatcctttcaaaaaaccagatcctggattcattgattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatgtagtgctataaattttcctctacacactactttgaatgcatcccagagattctggtatgttgtgtctttgttctcgtcggtttcaaagaacatctttatttctgccttcatttcgttatgtacccagtagtcattcaggagcaggttgttcaatttccatgtagttgagtggttttgagtgagattcttaatcctgagttctagtttgattgcactgtggtctgagagatagtttgttataatttctgttcttttacatttgctgaggagagctttacttcgaagtatgtggtcaattttggaataggtgtggtgtggtgctgaaaaaaaagtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcctgttgaactgatccctttaccattatgtaatggccttctttgtctcttttgatctttgttggtttaaagtctgttttatcagagactaggattgcaacccctgcctttttttgttttcctttggcttggtagatcttcccccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatatagttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagttcttttagggcaggcctggtggtgacaaaatctctcagcatttgcttgtctgtaaagtattttatttctccttctcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcattttaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaagttggttccattctccccatcactttcaggtacaccaatcagacgtagatttggtcttttcacatagtcccatatttcttggaggctttgctgatttctttttattcttttttctctaaactttccttctcgcttgatttcattcatttcatcttccattgctgataccctttcttccagttgatcacatcggctcctgaggcttctgcattcttcacgtagttcttgagccttggttttcagctccatcagctcctttaagcacttctctgtattggttattctagttatacattcttctaaatttttttcaaagttttcaacctctttgcctttggtttgaatgtcctcccgtagctcagagtaatttgatcgtttgaagccttcttctctcagctcgtcaaagtcattctccatccagctttgttccgttgctggtgaggaactgcgttcctttggaggaggagaggtgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttgcaataccctgccgtgtgaggtgtcagtgtgctcctgctgggggtgcctcccagttaggctgctcgggggtcaggggtcagaggcccacttgaggaggaagtctgcccgttctcagatctccagctgcatgctgggagaaccactgctctcttccaagctgtcagacagggacatttaagtctgcagaggttactgctgtctttttgtttgtctgtgccctgcccccagaggtggagcctacagaggcaggcaggcctccttgagctgtggcgggctccacccagttcgagcttcccggctgctttgtttacctaagcaagcctgggcaatggcgggcgcccctcccccagcctcgctgccgccttgcagtgtgatctcagactgctgtgctagcaatcagcgagacaccgtgggcgtaggaccctctgagccaggtgtgggatataatcttgtggtgcgccgtttttaaagccggtctgaaaagcgcaatattcgggtgggagtgacccgattttccaggtgagtccgtcacccctctctttgactcggaaagggaactccctgaccccttgcgcttcccaggtgaggcaatgcctcaccctgctttggcttgcgcacggtgcacgcacccactggcctgcgcccactgtctggcacaccctagtgagatgaaccagatacctcagacggaaatgcagaaatcacccatcttctgcgtcactcacgctgggagctgtagaccggagctgttcctatttggccatcttcggttctt

SEQ ID NO: 12537 - DNA, 6495 bp, Homo sapiens
cctgaagtgatcttcacccaattgttctttctgatcctaataagaacagaagtgccaactgtatgcaagtcactttttttgctcaattaatctgtgccacatttatggcttgcacagcgttggtggaatgatttactaaaaagatatcaaaacgacttttgccttcactgagcacatgattacagcttccctgctggggccttccatgaagggagacctacccagatggcagccaacctgaatggtaatcaccaacttgtacctactccacccaagcaactcaaatcttagcttctttttttttttttttttcaagtatttttatttttttattttttattttttatttttttttacattaaacagcagaagtctttgttagacctgaagtttattagaccttgtcttgttgacttagggaaattcttttttttttttttttaattttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattctccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagccccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcctacgcctatgtcctgaatggtaatgcctaggttttcttctagggtttttatggttttaagtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtcggttgttggtgtataagaatgcttgtgatttttgtacattgattttgtatcctgagactttgctgaagttgcttatcagcttaaggagattttgggctgagacgatggggttttctagataaacaatcatgtcgtctgcaaacacggacaatttgacttcctcttttcctaactgaataccctttatttccttctcctgcttgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacttcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtaggcatttggtgctataaatttccctctacacactgctttgaatgcgtcccagagattctgttatgtggtgtctttgttctcgttggtttcaaagaacatctttatttctgccttcatttcgttatgtacccggtagtcattcaggagcaggttgttcagtttccatgtagttgagcggctttgagtgagattcttaatcctgagttctagtttgattgcactgtggtctgagagatagtttgttataatttctgttcttttacgtttgctgaggagagctttacttccaactatgtggtcaattttggaataggtgtggtgtggtgctgaaaaaaatgtatattctgttgatttggggtggagagttctgtagatgtctattaggtctgcttggtgcagagctgatttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctacacgtgagatgggtttcctgaatacagcacactgatgggtcttgactctttatccaacttgccagtctgtgtcttttaattgcagaatttagtcaatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccacatcactttcaggtacaccaatcagacgtagatttggtcttttcacatagtcccatatttcttggaggctttgctcatttctttttattcttttgtctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcttcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttgtaacagacaggaccctcagctgcaggtctgttggaataccctgccatgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcaagcttcctggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtaaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctccaaatcttagcttctttattcctg

SEQ ID NO: 12538 - DNA, 5521 bp, Homo sapiens
tacatgtgtacaatgtgcaggtttgttacatctgtatacatgtgccatgtatacatgtgctgcacccattaactcatcatttacattaggtatatctcctaatgctttccctccccccttcccccaccttacaacaggccccggtgtgtgatgttccccttcctgtgtccaagtgttctcattgttcagttcccacctatgagtgagaacatgcagtgtttggttttttgttcttgcgatagtttgctgaggatgatggtttccagcttcatccatgtccctatgaaggacatgaactcatccttttttatggctgcatagtattccatggtgtatatgtgccacattttctcaatccagtctatcattgttggacatttgggttggttccaagtctttgctattgtgaatagggctgcaataaacatatgtgtgcatgtgtctttatagcagcatgatttataatcctttgggtatatacccagtaatgggatggctgggtcaaatggtatttctagttctagatccttgaagaatcaccacactgttttccacaatggttgaactagtttacagtcccaccaacagtgtaaaagtgttcctatttctacacatcctctccagcacctgttgtttcctgactttttaatgattgccattctaactggtgtgagatggtatctcactgtggttttaatttgcatttctctgatggccagtgatgaagagcattttttcatgtgtctgttggctgcataaatgtcttcttttgagaagtgtctgttcatatccttcgcccacttgttgatggggttgtttgatttttttcttataaatttgtttgagttctttgtagattctggatattagccctttgtcagatgagtagattacaaaaattttctcccattctgtaggttgcctcttcactctgatggtagtttcttttgctgtgcagaagctccttagcttaattagatcccatttatcaattttggcttttgttgccattgcttttggtgttttagacatgaagtccttgcccatgcctatgtcctgaatggtattgcctaggttttcttctagggtttttatggttttaggtctaacatttaagactttaatcaatcttgaattaattttggtataaggtgtaaggaagggatccagtttcaggtttctacatatggctagccagttttcacagcaccattttttaaatagggaatcctttctccattgcttgttttgtcagttttgtcaaagactggatagttgtagatgtgtggtattatttctgagggctctgttctgttccattggtctatatctctgatttggtaccagtaccatgctgttttggttactgtggccttgtagtatagtttgaagtaaggtagcgtgatgcctccatctttgttcttttggcttaggattgacttggcaatgtgggctcttttttggttccacatgaactttaaagtagttttttccagttccgtgaagaaagtaattggtagcttgatggggatggcattgaatctataaattactttgggcagtatggccattttcacgatattaattcttcctatccatgagcatggaatgttattccatttgtttgtatcttcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagattttgctgaagttgcttatcagcttaaggagattttgggctgagatgatggggttttctaaatatacaatcatgtcatctgcaaacagagacaatttgacttcctcttttcctaattggatactctttatttctttctcctgcctgattgccctggccagaacttccaatactatgttgaagaggagtggtgagagagggcatccctgtcttgtacctgttttcaaaggaaatgcttccagtttttgcctgttcagtatgatattggttgtgggtttgtcataaatacctcttattattttgagatacatcccatcaatacctaatttattgagagtttttagcatgaagagctgttgaattttgtcaaaggctttttctgcatctattgagataatcatgtggtttttgtcattggttctgtttatatgttggattacatttattgatttgcatatgttgaaccagccttgcattccagggatgaagtccacttgatcatggtggataagctttttgatgggctgctggattctgtttgcccgtattttattgaggattttttcatcgatgttcatcagggatattggtctaaaattctctttttttttctgtgtctctgccagcctttggtatcaggatgatgctggcctcataaagtgaattagggaggattccctctttttctattgactggaatagtttcagaaggaatggtaccagctcctcctagtacctctggtagaattcggctgtgaatccgtctggtcctggactttttttggttagtaggctattaattattgcctcaatttcagagcctattattggtctattcagggattcaacttcttcctggtttagtcttgggagggtgtatgtgtccaggaatttatccatttcttctagattttctagtttatttgcatagggtgtttatagtattctctgatgatagtttgtatttctgtgggatcagtggtgatatcccctttatcattttttattgcatctatttgattcttctctcttttcttctttattagtcttgctagtggtctatcaattttgttgatcttttcaaaaaaccagctcctggattcattgattttttgaagggttttttgtgtctctatctccttcagttcttctctgatcttagttatttcttgccttctgctagcttttgaatgtgtttgctcttgcttctctagttcttttaattgtgatgttagggtgtcagttttagatctttcctgctttctcttgtgggcatttagtgctataaatttccctctacacactgctttaaatgtgtcccagagattctgatatgttgtgtctttgttctcattggtttcaaagaacatctttatttctgccttcacttcgttatgtacccagtagtcattcaggagcaggttgttcagtttccatgtagttgagcggttttgagtgagtttcttaatcctgagttctagtttgattgcactgtggtctgagagacaatttgttataatttctgttcttttacatttgctgaggagtgctttacttccaactaagtggtcaattttggaataagtgtgatgtggtgctgagaagaatgtatattctgttgattctgggtggagagttctgtagatgtctattaggtccacttggtgcagagctgagttcaattcctggatatccttgttaactttctgtctcattgatctgtctaatattgacagtggggtgttaaagtctcccattatcattgtgggggagtctaggtctctttgtaggtcactcaggacttgctttatgaatctgggtgctcttgtattgggtgcatacatatttaagttagctcttcttgttgaattgatccctttaccattatgtaatggccttctttgtctcttttgatctttgttggtttaaagtctgttttatcagagactaggattgcaacccctgcctttttttgttttccaattgcttggtagatcttcctccatctctttattttgagcctatgtgtgtctctgcacatgagatgggtctcctgaatacagcacaccgatgagtcttgactctttatccaatttgccagtctatgtcttttaattggagcacttagcccataacaagcttaatattgttatgtgtgagtttgatcctgtcattatgatgttggctggttactttgctcgttagttgatgcagtttcttcctagccttgatggtctttacaatttggcatgtttttgcagtggctcataccagttgttcctttccatgtttagtgcttccttcaggagctcttttagggaaagcctggtggtgacaaaatctctcagcatttgcttgtctgtaaagtattttatttctccttcacttatgaagcttagtttggctggatatgaaattctgggttgaaaataattttctttaagaatgttgaatattggcccccactaacttctggcttgtagagtttctgccaagagatccactgttagtctgatgggtttccctttgtgggtaacccgacctttctctctggctgcccttaacattttttccttcatttcaactttggtgaatctgacaattatgtatcttggagttgctcctctcgaggagtatctttgtggcattctctgtatttcctgaatttgaatgttggcctgccttgctaggttggggaagttctcctggaaaatatcctgcagagtgttttccaacttggttccattctccccgtcactttaagctacaccaatcagatgtagatttggtcttgtcacatagtcccgtatttctcgggtactttgttcgtttctttttactcttttttctctaaacttctgttcttacttcatttcattcatttgatcttcaatcactgataccctttcttccagttgatcaaatcagctactgaagcttgtgcattcatcatgtagttctcatgccatggttttcagctccatcaggtcctttaaggacttctcttcattggttattctacttagccattcgtctaatcttttttcaaggtttttaacttctttgcactgggttcgaacttcctcctttagctcggagaagtttgatcatctgaagccttcttctctcaactcgtcaaagtcattctccttccagctttgttccgttcctggcgaggagctgtgttcctttggagggggagaggtgctctgatttttagaattttcagcttttctgctctgttttttccctgtctttgtggttttatctacctttggtctttgatgatggtgacgtacagatggggtttttgtgtggatgtcctttctgtttgttagttttccttctaacagtcaggaccctcagctgcaggtctgttggagtttgctggaggtccactccagacactgtttgcctgggtatcaccagcagaggctgcagaacagcgaatattgctgaacagcaaatgtttctgcctgatcgttcctctggaagcttcgtctcagaggggtacccagccgtgtgaagtgtcagtctgcctctactgggagatgcctcccaattaggctactcggaggtcagggacccacttgacgaggcagtctgtctgttctcagatctcaaactccatgctgggagaaccactactctcttcaaagctgtcagacagggacatttaagtctgcagagg

SEQ ID NO: 12539 - DNA, 6060 bp, Homo sapiens
tttctttttttttaattttattttattattattttttcttttattattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccacaacagtccccagagtgtgatgttccccttcctgtgtccatgtgatctcattgttcaattcccacctatgagtgagaatatgcattgtttggttttttgttcttgcgatagtttactgagaatgatgatttccaatttaatccatgtccctacaaaggacatgaactcatcattttttagggctgcatagtattccatggtgtatatgtgccacattttctgaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtaattctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattcttaatattagccctttgtcagatgagtaggttgcgaaaattttctcccattttgtaggttgcctgttcactctgatggtagtttcttttgctgtacagaagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccgtgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttacatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggatttttgtacattgattttgtatcctgagactttgctgaagttgcttatcagcttaaggagattttgtgctgagacaatggggttttctagatatacaatcatgtcgtctgcaaagagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagaaaatcatgtggtttttgtctttggctctgtctatatgctggattacatttattgatttgcatatattgaaccagccttgcatcccagggatgaagcccacttgatcatggtggataagctttttgatgtgctgctggattcgtttggccagtattttattgaggatttttgcatcaatgttcatcaaggatgttggtctaaaattctcttttttggttgtgtccctgccaggctttggtatcagaatgatgctggcctcataaaatgagttagggaggattccctctttttctattgattggaatagtttcagaaggaatggtaccagttcctccttgtacctctgatagaattcagctgtgaatccatctggtcctggactctttttggttggtaagctattgattattgccacaatttcagatcctgttattggtctattcagagattcaacttcttcctggtttagtcttgggagagtgtatgtgtcgatgaatttatccatttcttctagattttctagtttatttgggtagaggtgtttgtagtattctctgattgtagtttgtatttctgtgggatcggtggtgatatcccctttatcattttttattgcatctatttgattcttctccctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctctggtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgcagaaaaaaatgtatattctgtggatttggggtggagagttctgtagatgtctattaggtccgcttggtgcagaggtgagttcaattcctgggtatccttgttgactttctgtctcgttgatctgtctaatgttgacagtggggtgttaaagtctcccattattaatgtgtgggagtctaagtctctttgtaggtcactaaggacttgctttatgaatctgggtgctcctgtattgggtgcatatatatttaggacagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtatctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagcagctgacaccggttgtccctttccatgtttagcgcttccttcaggagctcttttagggcaggcctggtggtgacaaaatctctcagcatttgcttgtctgtaaagtattttatttctccttcacttatgaagcttagtttggctggatgtgaaattctgggttgaaaattctttcctttaagaatgttgaatattggcccccactctcttctggcttgtagggtttctgctgagagatccgctgttagtctgatgggtttccctttgagggtaacccgacctttctctctggctgcccttaacattttttccttcatttcaactttggtgaatctgataattatgtgtcttggagttgctcttctcgaggagtatctttgtggtgttctctgtatttcctgaatctgaacgttggcctgccttgttagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctcaatttttttcaaagttttcaacttctttgcctttggtttgaatgtcctcccatagctcagagtaatttgatcgtctgaagccttcttctctcagcttgtcaaagtcgttctccgtccagctttgttctgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcaggtgcaggtctgttggagtaccctgccgtgcgaggtgtcagtgtgcccctgctgggggtgcctcccagttaggctgctcgggggtcaggggtcaggtacccacttgaggaggcagtctgcccgttctcagatctccagctgcgtactgggacaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggctgctgccttgcagtctgatctcagactgctgtgctagcaatcagtgagactctgtgggcgtaggaccctccctgccaggtgtgggatataaactcgcgctgcgccgttttttaagcccgtcggaaaagcgcagtattcgggtgggagtgacccgattttccaggtgagtccgtcacccctttctttgactcggaaagggaactccctgaccccttgcgcttccggagtgaggcaatgcctcgccctgcttcggctcgcgcacggtgggcgcacccactgacctgtgcccactgtctggcactccctactgagatgaacctggtacctcagatggaaatgcagaaatcacccgtcttctgcgtcgctcacgctgggagctgtagactggagctgttcctattcggccatcttggctcctccc

SEQ ID NO: 12540 - DNA, 6064 bp, Homo sapiens
ttttattggttttctttttgcttatttatttttttttcttttttttttattatactttaagttttagggtacatgtgcacattgtgcaggttagttacatatgtatacatgtgccatgctggtgcgctgcacccactaactcgtcatccagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcggcatgatttatactcatttgggtatatacccagtaatgggattggtgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggctagtgatgatgagcattttttaatgtgttttttggctgcataaatgtcttcttttgagaagtgtctgttcatgtccttcgcccactttttgatggggttgtttgttttttccttgtaaatttgtttgagttcattgtagattctggatatcagccctttgtcagatgagtaggttgaaaaaattttctcccattttgtaggttacctgttcactctgatggtagtttcttttgctgtgcagaagctctttagtttcattagatcccatttgtcaattttgtcttttgttgccattgcttttggtgttttggacatgaagtccttgcctatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtactatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttttttgtatcctcttttatttccttgagcagtgctttgtagttctccttgaagaggtccttcacatcccttgtaagttgggttcctaggtattttattctctttgaagcaattgtgaatgggagttcactcatgatttggctctctgtttgtctgttgttggtgtataagaatgcttgtgatttttgtacattgattttgtatcctgagactttgctgaagttacttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcgtagatacctcttattattttgaaatacgtcccatcaatacctaatttactgagagtttttagcatgaagggttgttgaagtttgtcaaaggctttttctgcatctattgagataatcatgtggtttttgtctttggctctgtttatatgctggattacatttattgatttgcgtatattgaaccagccttgcatcccagggatgaagcccatttgatcatggtggataagctttttgatgtgctgctgggtttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatactttcagaaggaatggtaccagttcctccttgtacctctggtagaatccggctgtgaatccatctggtcctggactctttttggttggtaaaccattgattattgccacaatttcagctcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttaacattttttattgcgtctatttgattcttctctctttttttctttattagtcttgctagcggtctatcaattttgttgatcctttcaaaaaaccagctcctggattcattaattttttgaagggttttttgtgtctctatttccttcacttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggcatccttgttgactttctgtctcgttgatctgtctaatgttgacagttcggtgttaaagtctcccattattattgtgtgggagtctaagtctctttgtaggtcactcaggacttgctttatgaatctgggtgctcctgtattgggtgcatatatatttcggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacctgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcattagttgatgcagtttcttcctagtctcgatggtctttacattttggcatgattttgcagcagctggtaccggttgttcctttccatgtttagcgcttccttcaggagctcttttagggcaggcctggtggtgacaaaatgtctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaacctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcacttttaggtataccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttcttgagccttggttttcagctccatcagctcctttaaacacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgcgttttagagtttccagtttttctgttctgttttttacccatctttgtggttttatctacttttggtctttgatgatagtgatgtacagatgggttttctgtgtggatgtcctttctgtttgttagttttccttctaacagacaggaccctcagctgcaggtctgttggaataccctgccttgtgaggtgtcagtgtgcccctgctggagggtgcctcccagttaggctgctcaggggtcaggggtcagggacccacttgaggaggcaatctgcccgttctcagatctccagctgcgtgctgggagaaccactgctctcttcaaagctgtcagacagggacatttaagcctgcagaggttactgctgtctttttgtttgtctgtgccctgcccccagaggtggagcctacagaggcaggcaggcctccttgagctgtggtgggctccacccagttcgagcttcctggctgctttatctaagcaagcctgggcaatggcgggcgcccctcccccagcctcgctgccgccttgcagtttgatctcagactgctgtgctagcaatcagcaagactccatgggcgtaggaccctccgagccaggtgtgggatacagtctcgtggtgcgccgttttttaagccggtctgaaaagcgcaatattcgggtgggagtgacccaattttccaggtgcgtccgtcacccctttctttgactcagaaagggaactccctgaccccttgagcttcccaggtgaggcaatgcctcgccctgcttcggctcgcgcaccgtgcgcgcacccactggcctgcgcccactgtctggcactccctagtgagatgaacccggtacctcagatggaaatgcagaaatcccccatcttctgcgtcgctcacactgggagctgtagaccggagctgttcctatttggccatcttggctcctcccccct

SEQ ID NO: 12541 - DNA, 6031 bp, Homo sapiens
cctttttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgtatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaagtttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtagggaagggatccagtttcagctttctacatatggctagccagttttcccagcaccatttattaaatagggaatcctttccccattgcttgtttttctcaggtttgtcaaagatcagatagttgtagatacgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggctttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattttggtatgtggtgtctttgttctcgttggtttcaaagaacatctttatttctgtcttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaagtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaacctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccaggtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggccctcactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgttcgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctcctccaaaaa

SEQ ID NO: 12542 - DNA, 6043 bp, Homo sapiens
acttctttttttttttttttttttttagctattcttttttttttattatactttaagttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtgtcctggctttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccacttgttgatggggttgtttgttttcttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattaggtcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttctataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgacgaaagtcattggtagcttgatggggatggcattgaatctgtaaattaccttgggcagtatggccattttcacgatattgattcttcctacccatgagcatggaatgttcttccatttgtttgtatcctcttttatttccttgagtagcggtttgcagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgaccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggattggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaacgtatattctgttgatttggggtggagagttctgtagatgtctattaggtccgcttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactcttagatccaacttgccagtctgtgtcttttaattggagaatttagtccatttatatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgaatattggctcccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctcctagagctgtggtgggctccacccagttcgagcttcccggctgctttgtttacctaatcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcagtattcgggtgggagtgacccgattttccaggtgcgtccgtcacccctttctttgactcggaaagggaactccctgaccccttgcgcttcccaggtgaggcaatgcctcgccctgcttcggcttgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatctt

SEQ ID NO: 12543 - DNA, 36783 bp, Homo sapiens
tcatgtaacattaggtatatctcctaatgctatccctcccccctgcccacaccccacaacaggccccagtgtgtgatgttcaccttcctgtgtccatgtgttctcattgttgaattcccacctatgagtgagaacatgcggtgtttggttttttgtccttgtgatagtttgctgtgaatgatggtttccagcttcatccatgtccctacaaaggacatgaactcatccttttttatggctgcatagtattccatggtgtatatgtgccacattttcttaattcagtctatcattgatggacatttgggttggttccaagtctttgctattgtgaatagtgctgcaataaacatacgtgtgtatgtatctttatagcagcatgatttataatcctttgggtatatacccagtaatgggattgctgggtcaaatggtatttctagttctagatccctgaggaatcgccacactgacttccacaatggttgaactagtttacagtcccaccaacagtgtacaagtgttcctatttctccacatcctctccagcacctgttgtttcctgactttttaatgatcaccattctagctggtgtgagatagtatctcattgtggttttgatttgcatttctctgatggccagtgatgacgagcattttttcatgtgttttttggctgcataggtgtcttcttttgagaagtgtctgttcatatccttcgcccactttttgatgggtttgtttttttcttgtaaatttgtttgaattcattgtagattctggatattagccctttgtcagatgggtagattgcaaaaattttctcccattctgtaggttgcctgttcactctgatggtagtttttttttgctgtgcagaagctctttagtttaattagatcccatttctcaattttggcttttgttgccattgctttttgtgttttagacatgaggtccttgcccatgcctatgtcctgaatggtatggcctaggttttcttctagggtttttatggttttaggtctaacatttaagtctttaatccatcttgaattaatttttgtataaggggtgaggaagggatccagtttcagctttctacatatggctagccagttttcccagcaccatttattaaatagggaatcctttccccatttcttgtttttctcaggtttgtcaaagatcagatggttgtagatatgcggcagtatttctgagggctctgttctgttccattgatctatatctctgttttggtaccagtaccatgctgttttggatactgtagccttgtagtatagtttgaagtcaggtagcatgatgcctccagctttgttcttttggcttaggattgacttggcaatgtgggctctttattggttccatatgaactttaaaatagttttttcgaattctgtgaagaaagtcattggtagcttgatggggatggcattgaatctataaattaccttgggcagtatggccattttcacgatattgattcttcctacccatgagcatggaatattcttccatttgtttgtatcctcttttatttcattgagcagtggtttgtagttcttcttgaagaggtccttcacatcccttgtaagttggattcctaggcattttattctctttgaagcaattgtgaatgggagttcatgatttggctctctgtttgtctgttattggtgtataagaatgcttgtgatttttgcacattgattttgtatcctgagactttgctgaagttgcctatcagcttaaggagattttgggctgagacaatggggttttctagatatacaatcacgtcatctgcaaacagggacaatttgacttcctcttttcctaattgaataccctgtatttccttctccagcctgattgccctggccagaacttccaacactatgttgaataggattggtgagagagggcatccctgtcttgtgccagttttcaaagggaatgcttccagtttttgcccactcactatgatattggctgtgggcttgtcatagatagctcttattattttgagatacatcccatcaatacctaatttattgagagtttttagcatgaagggttgttgaattttgtcaaaggccttttctgcatctactgagataatcatatggtttttgtcgttggttctgtttatatgctggattacttttattgatttgcgtatgttgaaccagccttgcatgccagggatgaagcccacttgatcatggtggataagcttcttgatgtgctcatgtcatttgcccactatttaatggagttgttagtttttattcttgtaaatttgtttaagttccttatagatttattgattctggatattagacctttgttggatgcatagtttgcaaaaattttctcccattctgtaggttgtttagtctgttgatagttacttttgttgtgcagaagctctttagtttaattagatcccacttgttaatttttgttttagttgcaattgcgtttggtgtctttgtcgtgaaatcttagcctgtgtctacgttctgaatggtattgcctaagttgtctttcagggcttttgtagtgttgggttttacattttatgtttttaatccctcttcagttaatttttgtatatgatgtaaggaaggagtccagtttcaatcttcttcatatggctagtcagttatcccagcaccacttattcgacagggaatcctttccattgtttttggcaggtttgttgaagatcagctagttgtaggtgtgcagcattatgtctgggttctctactctgttccactggtttatgtgtctgcttttgtactaggatcatgctgttttggttattgtagccctgtagtatagtttgaagtcaggtagtgtgatgcctccagccttgttctttgtgcttaggattgccttggctatttgggcccttttttggttccatgtgaattttaaaatagttttttttttctcattctgtgaatactctcaatggtagtttaataggaatcacattgaatctataaattgctttgggcagtatggtcattttaatgatactgattctttctatccatgagcatggtatgtttttcgattatttttgtgtgtcatctctgatttatctgggcagtgttttgttgttctcctagtagagacctttcactaccctagttagttagatgtattcctaggtattttattctttttgtggcaattgtgaatgagagttaattcctgatttggctctaggcttgactttgttggtgtataggaataatagtgatttttgcacattgattttgtatcctaagactttgctgaagttcttctttatcaatttaagaggcatttgggcagagactatagggttttctagagataggatcatgttgtctgcaaacagtggtagttcatcttcctctctccctatttggatgccttttatttctttcaaatcttgcctgattgccctggtcaggaccaatactatgttgaacaggagtggtgagagagggtatccttgtcttggctggttttcaaggggaatgctttcagcttttacacacttagtatgatgttggctgtgggtttgtcatatatggctcttattatcttgaggcatgttccttcaatacatagtttattgagagtttttagcatgaagcgatgttgaattttactgaaggccttttctgcatctattgagataatcatgtggtttttgtctttagttctgtttatgtgatgaatcacatttattgatttgtgtatgttgaaccaaccttccatctcagggataaagcctacttgatcatggtggataagctttttgatgtgctactggattcagtttgccagtattttgttgaggatttttgcattgatattcatcaatgatattggcctgaagttttttgtggtgttgttaaatctctgccagattttggtatcaggatgatgatggcttcatagaatgatttagggaggagtccctcctcctcattttttctggaacagtttcagtaggaatggtaccagctcttcttttatatctagtagaattcagctgtgaatacatctggtcccagacttttcttaggctttttttttttggttggtaggctatttattcctaaatttcagagctcatcactggtatgttcagggattccaattcttcctgaagtctgtcttgggaggatgtatttgtccaggaatttatcaatttcttctagattttctggttgatatgcatagaagtgtccataatattctctggtggttgtgtttctgtgggttaagtagtaatataacccttgttactgattctgtttatttgactctcctccttttcttctttattagtctagctagcagtctatttattgtatttttttttgcagaaaaccacctcctagattcattgatctcttgaatagtttttcatttctcagtctccgtcagttcagctctgattttggttatttgttgtctctgctagtttgtgatttgtttgttcttggttccctagttcttttagttgtgatgttagattgttaacttgagatctttctaactttttgatgtggtcatttagtgctatcaatttctctcttatcactgccttagctgtgtcccaaagattctggtatgttgcatctttgttctcattagtttcaaataatttcttgaaaccttaattttacccagtattcacttaggagtaggctattctatttcatgtaattgtatcattttgagtgaatttcttagtcttaatttctaatttgattacactgtggtatgagagactttttgttatgatttcatttcttttgctttgctgaggagtgttttactttcaattctgtgtctgattttagactatttgccatgtggccttgaaaaaaatgtgtattctattgttttatgtggagatatctatcaggtccatttgacccagtgctgagttctgatcctgaatatctttattaattttctgtctcaataatgtatctcatattatcagtgggttattgaagtctcccattattattgtgtgggattctgagtctctttgaagatctctgagaaagagcatgctttacaaatctgggtgctcctgtgttgggtacatgtatatttaggatggttagattttcttgttgaatggaaccctttaccattatgtaatgttttgtctttttttaatctttgttggtttaaaatctgttttgtcagaaactaggattgcaacccctattttttttctgttttatgtttgcttggtagattcttctccatccctttattttgagcccatgtttgtcattgcatgtgagatgggtcttttgaagacagcatacaaatgggtcttggcactttatccagtttgccactctgtgtctttcaattggggcatttatcccattgacatttaaggttagtattgatatatgtggattttatcctgtcctcatgatgttggctggttattttgcagacttgcttatgtggttgctttatagtgtcactggtcgtgtacttcagtatatttttgtaatggctggtaaagatctttcctttccatatctagtgctttcttccagagctcttgtaaggcaggtctggtggtaacaaattccctcagcctttgcttgtctgaaaaagatcttatatctcttttgcttatgaagcttagtttgcccagatatgaaattctagactggaatttattttctttaagaatcttgaacattggctcccaatctgttctggcttgtagggtttcagctgaaacgtgctctgttagtctgatggctcccctttgtaggtgacctggtttttctctctggctgcctttaacatttttttttttcatttcaaccttggagaatctgatgattatgtgtcgtggggatgatcttcttgtgaagtatcttactgaggttctttgcatttcctgaatttgaatgttggcctctccggtaggttggggaaatttttctggatgatatcctgaaatatgttttccaattttgttctattctcctcatctctttcaggtacaccagtgagtcatagatttatttggtatctttacataatcccatatttctctgaggttttgttcttccttttcattcttttctctctactcttgtctgcctgtcttatttcagaaagaatctaaccctgagattctttcctctgcttggtctattctgctattaatgcctgtgattgcattatgaaattcttgtagtgtgtttttcagctctagccagtcagttacattatcctctatactggctattttgtttgtcagcacctgcaacattttatcatgatttttagcttcctacttttcaaatcttaatgctaagttagaatattaaaaaataatacatagtatgatagcactttttatactttcttaattttaatggaaatatgccctagtgttttatcattagtatgatgattccaattggcataaaataaaaaagcattctgttattttaataaattatatttctattttaacttatatttaaaatagtataaattatttttttgttcttatgctctgtatttttgtgatttgggaattttgccattagattgttgtatgggttacaatgacttatatctcatttatctggtgtatgtgtgtgtgtgtgtgtgtgtatttgtcctatctttatgtttgatattagggttattccaggttttaagaattatttgttgaactttatattttttctattatttaaaaagtattggacctttactatgttttttaaaactaattttattgatgtttactataaatacaataaaatgtacacacatttaaatgtactttgattattttttgttgttgttgttgagataggttctccttctgttgcccaggctggagtgcagtggtgctaccatggctcactgcagccttgatcttctgggttcaagcaatcctcctacctcagcctcctgagtaggtaggaccacaggtgtgcactaccagacctagatttttactttttttttgtaaagacatcatcttgctaccttgctcaggcttgtcttgaactcctagcctccagctattctcctgccttggcctcccagagttctgggattacagatgtgagccactgcaccaagcctaatgagttttgaaaaaataggtgcaccatacttcttatgtgcacttatataacaaccataaaatcaagatataaaacatttcctgcacccttaaaagttagttagctttttgcaattaatcccttccacacctctggttcgatataacccagaccttctttatgacgctagattaaatatttcttttatagaatttcatatacatgaaaatttaaaatatgtacttttttgtttctggagtcttttgctcagcataatgcttttgtgattcatcaaagtttttgcatgcataaaaagtttatttctttttattgctgggtagtattaaattacacagacatgccacagtttatttacccatatacttcttgattgtttttttttttttttttacaatttggtgtcatgtaaaaaaaaaaaaacgctacgaactcgtaaatgtggtaaggacgtgtttttatttctcacgcattaacatccacaagttaatttttcgggtcatataagtgcatgtaaccttataagaaactaacaataattgtatcattttgtcatttcccccagcaatgttcaagggtttcagttgctttacatcctcattggttttgtcagtttttaatgttagccattctcctgggtatgtagtggtatattattttggttttaattcacattgttttgatgactagtgatgtcgagtattatttcttgagcttcttagacattatgccatcttttgtaaaatgtctttaattcttttgccgattgaaacattgaattttcttattataatacatatacatgttagtctagatacaagtatttttcagatacacaagtctgcatattcatattcttaacagtgtccttttagaagatatgtattattatgtaaaagcccaatttatcacttttttctgtttcatgtttactgtgtatcgtatctcagagtcctttgcctatgccaagattgttaacgttttccttaaatattttatatgcatagcctgtcctttgccagataatgaggctgaatgaaagcaagcagagcttggagaatgagagaaggaggatgactctaagttctcttttattctagacttggtttagtgccatttaaactaaagtctgaccattctggggatcctactgaatgtccctgctgtttattaaggtcttcctactttgcctagttgcaacttcaatctctcctagtctaatgtgacctcgaaaattgttcagctttcagctctttgtgattctatcccatgtatgcaaaggatcatatccagcaacatatggatccagcaacatccagatataagagacccctatgcagatttcagagtttttcttctgcctggctccttcctctctgacactttgcctttcaaattctagttgtctcagacttcccagactctgatgtttctccccgacttgacaagactgctatactctgattaattgagccctttttacacagcagtctggaaatggcctccaagcagaaagctatgagtttatagggttcaaatacattgcttccctttcagcaatcacaattctgtgttttttgttgtccagtgtctaaatttttttcccatatagtttatccactgttctggttgtttacagcagtaaggcaaatctgggatgagatatctataatgacaggaattggattctgaatgttttgttttgttttctttcaattgtgtcaaacacacagaaaaaattattattttagccatttttaagtttataggttagtggcattaactgcatgcacactgtcatgcaaccatgatcatcatccatcgccagaattttttatctttcaaaactcaaattctgtacccatcaactctatatctattaaatataactcctcatttccccttttccacaatcctactttccgtctctataaatgtgactgatctcggtatctcatttaaattgaatcatatggtatttgtccttttatgtccagtttattttcacttgacataatgtcttcaaagttattcttattgtagtatgtgttaatttcaccttttcaaagctgaacaatattccattctagatatctaccaggttttgtttatccattcacctgttgatggatacttgtgtggcttccaccttttagctattgtaaataatgcttctataaacatgggtatacaaatatattttccagttactgttttcaattcttttgggtgtatatacagaagtggaattgctggataatatggtaggtttattttcaatttttgaggagccaccataccattttccacagcagctacaccattttataacccatcagcaatgcacaatggttccaatttctgtacatcctcaccaacagttgttattttccatttttgtgtgtgtgtgtttttagcaagtatcataataggtaggaagtggcatctcattatacttttgatttctgtttccccaattattagtgatagtgatattgagcttgttttcataagcttatggaacttttggatatcttcattgataagtcaatttaagtctttgcccagttttaattgggttgtttgtgtttttgttgttgagtgatagaagttcattataatattctgatattaattaattaatccatatcagatatatgattaataaatattttctcacattcagtgggttgcctttttactttgttgataatgtcctttgatgcataaaagttttacttttgattaagtccaatttactcattttttttttctgttgtcgcctgtggttctgttcttgtaatattcaagaaatcaatgccaaatccaaggtatgaatgtttcccccttgttttcttctaagaatttttactgtttcagcattttaatatatttgtctcttgtaacagattttaacttagttaatttgcttgatgttagtgcagcatttctgctcacttttagttacattttgcattgaatatctttttacattctttaagtttcagcctatatgtctttaaatctaaactgagtctcttgtaggtaacatatagtctggtcctgatttttattcattctgccaatatgttttcagttgggggggttgtttagtctacctacatttaaaattatcattgatagtaaagcacttatttttaccactttgttattagttttctgtatgtcttaaagcctttttgtccctcatttcctccactactgcctttctttgtgtttaattgatttttttggtagcagcgtgttttgattctcttctcattttctttcttaaatattctatagatgttttctttttgattacattgaggattacaaataatagcccaaaatcattatctttttaaaattgatactaacttaactccaataccataacaaaattctctacttctttacagttccactctcccctacttaattttaccgatgacacaaattacatcattatatattgtgtacccattaacatgcattcataattatttttattcatttgtcttttaagtcctgtagaaaataaaaagtaaagttacaaagcaaaactgtttttatttgtcatatatttgtctttaccacagaaacttatatttttgtatttttgtatgacttctagttacttgtctagtgtactttcttttaaatgtgaaggacttgcattaacatttcatgtagagtgggtctggaggtaaggaattcccagcttatgcttgtgtgggaatgttggaatgttttaatttcttcctcatttttaaaggacaattttgttggatatggaattctaggttgatagtttttctttcaacatttaaaatatatctttccattgccttctgccctgcaaagtttctgctgaagagtccacttataatctcatcagggatttctgtaagtttttgttgtctagaattttatttttctttctattcctaaatctagtagaattgaatcaatttaatgttccttaagagtttgacaatacattagtttaacttttttgtgtgtcatttgataactgtttttgttgttgttgtttgtttctttgtttgttttgagacagagtcttgctctgttacccaggctggagtgcagtggtgtgaactcggtcactgcagcctccacctcccaggttcaagtgattctcctgcctcagcctcccaagtagctgggattacaggcgcccacaaccacacccagctaatttttgtatttttagtagaaatgaggtttcaccatgttgtccaggcttatctcgaactcctgatctcaggtgacccacccagctcggcctcccaaagtggtgagattacaggcgttagccaccgtgcccactgtatcatttgatgacttttgtttttattctctttacttgatattaatgttgctgatgaaatcgactatatgatgtcacaataatgccaaaataaaataaaaataaaataaaactcttaaccctcagtgggatttgatgttaagcagctgttactcacacttgtggagtcatatgggagttggttaggtaacactgtttttcttggttcaattcatgtctggctattgaatgactgtcagtcagctggggtgactagaacctagcacattggaggactttgcactgttacaactgtctttccttttctaacaggccagactatggatgcttttgtggtgatagcagaggttaggacgtccaagcccacatacacaagctgattttaagcctctgcttgcattaagtttcctaaggttctattttctagggcacgccctacatttgtgtccatatcaaggagtggaacaagtcaccccacttatgatgtaactaaaatttccaagagaaatgagatggattcagggagtggtgaattggtgccattattgcactataacacaccaacctattttctttttattttgtatagaatatacttagttctctatttatttaaaattgcctgtgtacctcctttaaatatcttgttactttttaaaaaaagtttatttttattttttgctttttaataggcagggtacagaactgctcacatatcatatatattcttttctctagtgtaatttcatcattttgtttcattctttctactttatatatttccattttcttttttttttttttttgagacggagtcttgctctgtcgcccaggctggagtgcagtcgcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcctgagtagctgggattacaggcatgcaccaccatgtctggctaatttttgtattttttactcctgctccagtttttgagatgtattttttcttgcattctaatgaaaaatattttatatcttttaatagataatagatatatttgttgattatattaggtgatgatttctttctcttgtatttatcaccaggatcctactggtttattcctcattacttattctagggccaggtaaaattgactttagcttggagtggaccagcactttggatgtattgattggtattgatatgtattaaattcttgtcagaattccaggtggtgagaaggtggatgtatagatttcccacacaatttgcacggtgtagcatgcattcatattgtattgtgtttcaatatatttctcttcctcattctctgatatttacaacaaatgaaataatttttccaaatatctctcagctgttaatataggaatggaatgcaagtcttgcttctccttcattgccttccttatttctcttcatctaatcaattgtgacaatattgtgtatatacttgaaaactagaattattgtaagaaatgcatattatctcagtattaaaataatacgttacctcttgttttgctatgtttttctgggatagattctttaaagtggaattactggcataaagtgcattaatacttttgttaatttttggtatggattgaaaaattatttcctgaatattattatcaaattaaagtgctagaagcagtatgaacatatactatcatctggaaaaaaaaccactatgggaattatttgcttattatgaaaaaaatagaatcacaaaaatctgtgaaaaagaaaacaaaaggcagtcatcatttcattgtctagcaatgactattgctattcatctggtttagttatttattttctgccctagttctttctagggtagatagataagtatatagagcaatatatagatagatagttaatagttatagaatgcacacatggatgaaaatactataaggatgagatttaagatgttttacatttttgtcccattatacataacccagcggttaaagtctttacacttattacaaatggtttgtaagtcctagaaagaaaattaagaaaaagatttgttaagtttatgtgtacagtaagcacacacatgcaaaatttcaaaggaatgttgtatcaacttatgatctcaacattcatgttatattaatatttattatttaattttttgaaacattttaaattttatggggaaaatattactttattgttttgtattgatgactagacaagttaaatatattttatgctaatgcttattgtacaaggactactctgtaaaacttttgttaaagtttataatcaatgtttcaactttgattagtacccattgcactttattaacaatcttattttcgctcacacccattactattatattttgtacagataaaaatctcttcttaattttttaaccaatcacatttatattttccattacttttggttcagaaaatctttttacataattaatacattaccttcaacattgcagttgctcagtaaattatgttgaagggctcatgaaatgaaatcctccctaccctccacatttaattctgttctttgcaatagcaacaggaataaaatattatcccagtactcagcttgactgacattttcttatttcagataataaaagaccatgccttgaattctctcagctaagtgtaaaggattccttcagagatttatttattccgagaatagagaccattctgatgatgtatacaaggaacaacctaaactgtgctgagccactgtttgaacaaaataactcacttaatgttaatttcaacacacaaaagaaaacagtctggcttattcacggatacagaccagtaggctccatcccattatggcttcagaacttcgtaaggattttgctgaatgaagaagatatgaatgtaattgtagtagactggagccggggtgctacaacttttatttataatagagcagttaaaaacaccagaaaagttgctgtgagtttgagtgtgcacattaaaaatcttttggtaagtctgggaattttatgtattatacatgctatacaatatattatacgtgctatacaatatgcagtgtgttacattcaataccacaaagtgataataaactatatacttttccccataagcattaacaattactggtttgatataccaatgtatgcagccatcttttctttgtctgcctaaatgaataattctatacctagacatatcctgtgttatttttaaaacattatattaaaatttagtaattattaggttttatttaaaaatcttctgagatttcttttaactctacctataccaacctcagaataaaatagttatcctatgtgggtgggggaaataaactttataattattacaatcttcaggtatcttttaaaatatacggctaaaatatttgcatataatcgagtgtgaattggtaaaagtaaagaaaaatctttttttttttttttttttttttttttgagacagggtctcactctgttgcccaagctggagtacagtggcacgatcttggctcactgcagcctgcacctcccagggtcaagtgatactcctgcatcagccacccgagtagctgggattactggtgcccaccacaatgcccagctaatttttgtatttttagtagagacgaggtttcaccatgttggccaggctggtctcgaactcctgacctcaggtgatctgcccaccttggcctcccaaactgctgggattacaggcaaaaaatcattttgaaaagtagcatacttctgtcagctttggaggtgaacatcagattcattcaagtctgctcaggatttgaatggatcaaataaaattcagtccagttctatgttatctgcactgtgaatgatttttgtttattaagtcaacccttagggagatccatgtctatcctaaaagaaagtaggtagttgtgggtacttgagagaaagaagggtgatatctgattcgggggcattattgagcttgaaatttaaacttgagttgtgttgtgctgaactttcaagactctgctaaaaattgaacaaataacaacacttccaagaagccgttatatgtagtggccaggggtcagactggatgggttcaaactgtatgtccatcttttatcatctgtgtaattttgaacaattacatagcctctctgtgctgcatttccttatttgtacatatagaataacaaaatgttacaaaaatatttatatgaatattgaattaatatatatgtgcttaatcagtgggtgacatttagtaatcattgagtaagatcaactttcattattatttttacacccccaaatttggacaaaacaataccattgctgtagagagacagaggaggtaattgattcaaccatctccaccaacagactattaattacatcattgatttttcctgatgttactggtgttttctcaactaataaatatgtgcctcaaagtgtggagaatgtgaatattaaatagaaatatttaggaaaatttgtaatattagataaaattctaacagtgcctttgcttacagaggcttcatattacagaggaagatttaaatgaccggcagcactggagtctcgagagatactcccttatgttttggggcatggctgtgagaaatctgaagaaaatcataaccttgtgccttgaaagcctgagggtagtttttcattagtggcaagcgctccacatctttctgtaagccatcagacatatcactgtgtgggctggaccatgatctgtccacaagtctcacaatagctccccaagagtgtggtggaagtacactctcatgtagtcttctaatttcccttcctggagctgagactaagaggtattcagacgttggccttggaagattggatgcatcactcctgagctggtgatcaggggaaggaagtcacctaaaatccataaaattaatttcatcatctctgaagtgagaatcattattgaacttttgtgaatcttcctaaggtttttgacacaacctgatcagataaaacaagaaggcaaattagcataattttggagtgagacctaggtttgtgttttagtccatttgggctgctgtaacaaaataccataggctaggtagcttataaacaagaaacatttatttctcatagtttcagggtctgagaagtccaaggagaaggcatcagcagattcagtgtctggtgagggcccaattcctggttcatagattatgccttttcactgtgtcctcacatggtggaagagtagaaggagatccctcaggtctcttctatctgggcagtaatccctttcatgagggttccacactcatgacataattctcctaacccacaagaaggcctcacctccaaatatcatcaccttggggattagaattccaacatatgaattttagggagacacaaacattcagaccacagcagcttggaatccatcttttcctcttatgaatctatgtggctttgggaaagttgttacttctggcagtttccttaataaaattggaattgatccaatattatttatttagcatttaataggtgctactgacagttttaggcattagaataaaaatgaataactcataacgaaattggaagtattaaatatgaactttgtaaggcccatatcgaggtagctagcagaaagtaagcacctagtaatgttgattattataaaacactctgctaattaattgcattttgcatactgttctgcatgagatgatacaattttaaaataaattgatattaaaaatgaataaagaaaaatcaaatattttgtggcaaaagttgaacaaatatatagtcatcttgaaattataaagtctctttcccgatatccccaaaatgaatcaagccagaaaaataatgaattttgaaatgttgatatatgaggggggcatgatttgttattacttgaaatgaatactgtaatattgcctttctctttaattgcagaagcatggtgcatctcttgacaattttcatttcataggtgtgagtttaggggctcatatcagtggatttgttggaaagatatttcatggtcaacttggaagaataacaggtaaaattatttttataaaattattgctttagcatacttttaagtatcagaagttactttgctaattttttttttttttttgagacagagtctcgctctgttgcccaggctgcagtgcagtggtgcgatctcggctcactgcaacctctgcttcgtgggcttaagtgattctcctgcctcagcctcctgagtagctgggattacaggtgcccactcactaccacaccggctaatttttgttttttttaagtagagacagggtttcaccatgttggccagactggtctctaactcctgacctcaagtaatctgcctgcctcggccttccaaagtacttggattacaggcatgagccactgtggccagccactttgcttaaaatttagtgggtacaataattactcaatagaaattatgtacaaacatttattttttctatgttatatttaaatattggctttgttttagttagactctaaagttttgttaagttctcaacagagcttaagttacccaaatggaaatgggagaaaaacatctattcctgcagtcccagctaaattttaaggacatactatcgtaagaatacagaagtaaatatgactcattaaagaaaaatactttatgtattagctaagaatataactatttacttagttatcacaaactttgatgcatttcaactctctaaaaatttttacttgaatgctacaaaagaatcaggagttgcatccaatttgagggactctgggtcccccttcatatttctataacaaagttactgcatccaggaagctcagtcatctaataaggctgatatggattttcattctttcctctatgagtggtagtgactttaggaataggaggataatattcctttcaaccaatttaccttttttgttttgaaaaaaaagcaattattcatatctatggccatagaagacttataataactttaagtgttgataaaagaaaatagtgtccttagttaagtttcaaaaaagggggaaagaggtgaataacatatagatagttatctttacaaaccttatgcatacccttacttactctgattagttttaatgttatcaaatatgtgtgaaaacaaattaactgaatgaatgtaggagggtcaagaaatagcagtttagccaggatttacttatacaaagttccctagtgcttaaagctcattctctttccaaaaccacacttgctcaatttgtactttaaattgtgtttacacatattagtctagcttgaatggcccaaataccaggcaatcatcaggtactaaaaggccaccaaacatggaggttctatatcagaatgatttataggaagatagatgattctgtctcattcagtcaagtgggttaaataaaatggggataatagaggtttttgaaatgaaaaacattatattttactttttttctaggaatttttcagttttatttaaaatttttttaaattttattattattatactttaagttttagggtacatgtgcacaacgtgcgggtttgttacatatgtatacatgtgccatgttggtgtgctgcacccattaactcatcatttagcattaggtatatcgcctaatgctatccctccccacttcccccaccccacaacagtccccagtgtgtgatgttccccttcctgtgtccatgtgttctcactgttcaattcccacctatgagtgagaacatgcggtgtttggttttttgtccttgcgatagtttgctgagaatgatggtttccagtttcattcatgtccctacaaaggacatgaactcatccttttttatggctgcatagtattccatgctgtgtatgtgccacattttcttaatccggtctatcgttgttggacatttaggttggttccaagtctttgctattgtgaatagtgccgctataaacatacatgtgcatgtgtctttatagcagcatgatttataatcctttgggtatatacccagtaatgggattgctgggtcaaatggtatttctagttctagatccctgaggaatagccacactggcttccacagtggttgaactagtttacagtcccaccaacagtgtaaaagtattcctatttctccacatcctctccagcacctattgtttcctgactttttaatgatcgccattctaactggtgtgagatggtatctcaatgtggttttgatttgcatttctctgatggccagtgatgatgagcattttttcatgtgttttttggctgcataggtgtcttcttttgagaagtgtctgctcatatccttcgcccactttttgatggggttgttcgtttttttcttgtaaatttgtttgagttcattgtagattttggatattagccctttgtcagatgagtagattgcaaaaattttctcccattctataggttgcctgttcactctgatggtagtttcttttgctgtgcagaagctctttagtttaattagatcccatttctcaattttggcttttgttgccattgcttttggtgatttagacatgaagtccttgcccatgcctatgtcctgaatggtattgcctaagttttcttctagggtttttattgctttaagactaacatgtaagtctttaatccatgttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcagcattatttctgagggctctgttctgttccattggtctatttctctgttttggtaccagtaccatgctgttttggttactgtagccttgtagcatagtttgaagtcaggtagcatgatgcctccagctttgttcttttggcttaggattgacttggcgatgcgggctcttttttggttccatatgaactttaaagtagttttttcgaattctgtgaagaaagtcattggtagcttgatggggatggcattgaatctataaattaccttttcacaatatattgattcttcctacccatgagcatggaatattcttccatttgtttgtatcctcttttatttcattgagcagtggtttgtagttctccttgaagaggtccttcacatcccttgtaagttggattcctaggtattttattctctttgaagcaactgtgaatgccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgctatattttactttcaaatatctttttaagatgattgtttcttcattgtatagatgttctcaaaaaactgaattttatcttctctctcctctttttgacaattcccagaaagtcatgagcctagcatttttatttagaaattaagataacccagaaataatattcacactccatggaatttaaaatatattttttcttttcttaagagtgtgtgagaaagtcttacgagaaatggataagataacatgatttatcccatagcccaaattatatttggcacctaaaaaagcttttcaggtctatctacagataaatccaaagtgagctagtaatgtacagagttcaagagaggaccagatggtattcattatttttttccttcaggagaaatagttgtagttattattaaatataaactactttattactcctaattcagtctcacagaaaaatactccaaaaattccgacaatattttgttgcggcttaacctgaaaagctctgaaggttagtagtattattcaaatactgaagttacctgctgttcattcacttccatttgtttttagatatgttcttggataggtttaaactaaaagtataaatgctttttatgtttataatgcagtaataatggaagtatgcaatgtaaggagctctgtggacttgatgagactgattatttctttcttgctttccaggtcttgaccctgctgggccaaggttctccagaaaaccaccatatagcagattagattacacggatgcaaagtttgtggatgtcatccattctgactccaatggtaacaaatcaggatttattacctaattatttgaaaatgaaaaggaaaatgtagaccttgggcaagaggagggcataagaagaaaaaacatcatggataaaatgattttaaatctgtaattatagaatgataatatttcccaagcaatatttcttagggttagtgatttcctgcattgtcaaatggcactctttgacttcagtttgcctccttcgggtttcaagatgtgtcatgtcatcctaaaacactgaaatagataactaagagttcattctgttcatgctgttgacaattttattgatttgatcacattttcccccatgtttaatgttcctgatgtatttaggttaccattctccccgcttattttcttgctatgatatatatcgactagaactgaacacagcatttcagccacaaataaagaatagtcttccttaaatgtaaggaaataatctttctattgtttttaattatcttagctgaaaatctctaacagggtattggatttttggccagagtacaattgaacagacacttttaagaaacagactgtcctcgtgcctttcctgatttgaatttgttgatactaatatttactgagcacttcctatacattaggcagtgttttgagtgcttgtatgaattaattagtgaattctactaaatttccgttagatagataacaactgtcattccctttacagttgaggaaactagaataaaggttgtaaggtcagtaaatggcagagtcagaatttgaaatcatatgttttgattccagatgatgcacttaaccagtatattattcttataaaccgaatcaggagaggatatggtggtaagatagagacaagggcagtgacactaagattgctcctctgaatttatcttgtggtgatctatacttgggtttatgtgtctgtgtgtgagatacgtaaatgccatagatgcaatttttcaacccccatgactacatgtcaatagattgagactccactggtaacaattctgctcctttttggaatctaggttcacctacttctataagcagtcaaaaccaaagaagtcatagtttagtgttatccaaacctctcatgtcttattatctctaactctttatatcagcttggcacatccacataaaacacatctattggccaattaatgtgtagtcccttgtctgaattttttctgaaactctaacttattgggggaacccacccccgatatttcaatgtaggttctttctattttccataagtgtcggccagctgagaaataaagagagacagtacaaagagaggaattttacagctggtccaccaggggtgacatcacatatcagtaggaccacgatgcccgcttgagtctcagaccagcaagtttttattaagggttttaaaaagggaagggggtgtaagaacagggagtaggtacaaagatcacatgcttcaaagggcaaaaagcagaaatattgataaggttctatgttcagcagtgcatgtattgtcttgataaacatcttaaacaacaaaaaacagggttcaagagcagagaactggtccaaccacaagttaccagggcggagcttttccccaccctaggaagcctgagggtactgcaggagaccagggcatatctcagtctttatctcaaccacataagacagacattcccagagcggccgtttatagatctcctcccaggaatgcattcctttcccagggtattaatattaatattcctcgctaggaaaagaatttagcgatatctttcctgcttgcacgtccatttatacgctctctgcaagaagaaaaatatggctctttttgcccgaccccacaggcagtcagaccttatggttgtcttcccttgttccctaaaagccgctgttattctgttctttttcaaggtgcactgatttcatattgttcaaacgcatatgttttacaatcaatgtgtatggttaacacaattatcacagtggtcctgaggtgacatatatcctcagcttatgaagataacaggattaagggattaaagtaaagacaggcataagaagttataaaagtattatttgggaactgataaatgtccaggaaatcttcacaatttatgttcctctgctgcggctccagccggtccctctatttggggtccctgacttcctgcaacactaacttcaattctgcctatggccttttgacttagctcttcatactttttattatttttgtttgcatttttgacttatcctaatgaactgtcttggattgtcttatatttgcaacatcttttgatgatgcaacctatcagatctaatctgccactagaggccacatagttggaacattggattgatcttttcatgactatcacaaataagaaacacagattttttgatgctgcatatgtacctgtccgagaaatttctgaatgatatgcgtggactcagcacatacctggtgaactgccttttccttgaatactagataatgaccacatcttctacttgccagtaatcctcatttttattcagttgtgagtgttcagaaagccatgtggcctttcaaatttgtggattagataattagggcatacatttttgctgagatattggggaaaattatgagtccaatatccaaaagatagatgcttttgaaaccctcatattgggtttgcaaaacatctcatctgttattcttgtctggaactccaaaggacattatagaagcatgggtaaagctgaacaaatcagccttcttatggtctgcagaaagcttctcgttatctgagttgcctctgccaaaatcacgtttactgagttttttgtttaagtagattctgaattgttagaactcctagttatctgacagaagcaaacaatagccttctttgtaggaaattcacataattcaatctcaaattatttttacaaaaacatattaaaataaatgtttagcatccaagatagccaggcacacttggagcaagacagcgtgaatgagaaacagcagaaacaacagtcaatagacaacacccataggcctccagatattggaattattatacactggctataaaaaatgtgcttattattaagttggtgcaaaagtaattgtggtttttgctattaatattttcaaaaaggtagaagactgaaaaatttaacaaaaaattagtaagtataaatttatcaattatatttgacaaaaataatgaaagttcttaccctaaaaagtaaaataattgacatccattgaatgggtttaacagaaaattagaaataggtaaagagagagtgagcgagtgaactaaaaagtaggtgaaaagtaaatttctagactgaagcaaatgggtaccaaagaatagacaatatagaccaacagttaagagatgcataggataggcaatgacatggtaaattacattgtgttagaattctggaataaaaaggcagaaaaatggaacaaagactatatttaaagagatattatctcataattttcccaaactgagtaatataatcagtctacaagttcaaaatgcccaattaattccattcaataagaaaaataataaagattaatctccattgagatgtatgatagtgaattgcagaaaaggccatcatcaaaccgtacaagtttatttaaataaggtgaataaaattgaccagagttacaattgagttctcaacagaaacaatggaatataggaaacaacagaatgattgcttccatatggtgaaaggaaacaactgctaagatagtatctcaatctgtttcaagaataaatgtattttatttcagacaaatttaaactggagagaaactgtcatgagcagaaaggttacccttcagacattcatgagcagaaatgtattcttcaggcggaaggaaaattattcttagattgtggctattttggaaggaagaacaatgaactagttaaatctaagcatatgttgatggcataaaatactattaataatgttttatggacttgaaatatagaaaattaaaataagctaaaaatagcatatgattttgggtgataaatgaatttccagctttctgtgttcctttcattgtatagaaagaaggtgaaaatgaccttcagtaattgatattcataagtatagtattcatgttgaatctttagggtatctagcaagaaaagaagcaagaaaatgaaggacaaaaattgaatatactttttatgaagtctaaaagaaggcaagaaaagagagaaagaatgcatacaacagctaaagcaaatagaaggtagataataagatagtaaaatcaaacacaactatacaattaagataaatggacttatgctctaattaaaatattatggctgtcaaacttgattaaaaagaaaaaatccaactcttatttattaaagacatatataaaagcaaggaagcaaaatatttgaaagtagaagggtgataaaaaatatgcaaatattatcctccaaatggtggtaaatctatattagacaaaattgattttatataaactaataaaaatatggacagactttaaaataataaaactttgaactcacaaagaagatataacaattgtagtttgtatgtacctaataacacagcttcaaatacataatgcagtattaacaataacacattgcaaaaaaaggcaactacacaatcatagtgaataattttaattaacacaattgatctaatagacatttatagaacattacacctgagaactgcagaatttacagtcttctgaaacacaaatggatattttagctaagttaagcatatactgagccttaaaaatattctcaaacatttcgatatacctaatgtaaatgaggcgttaacgggtgcagcacactaacatggcacatgtatacatatgtaacaaacctgcacgtagtgcacatgtaccatagaacttaaagtataataataataataaaagaataaataaataaatataatcagagctatgagggcattattagcgaaatgtaaccaaaaaaaaaaaaagaattgaaagcaaataaaaatgtttgtatctgaaaaaaaaaacaatattctcaaacatttcaaagtgtagaaatcataatcttttctatctttaatgcacttaatccaaataaataacaaaaatataactaaaatccatacatttttgaaagtgaaaaatcacatttaaaaataattaatgaatacaataataaataatataatcaaatattttgaattgaatattcacattattgcatattaaaactttttggattcagcaaaggccatggctagaagttaatgtatagttttgagtacagctattttaaaaggctgaaaatcaataatctaagcatctattttgaaaaattaagaattaaacgatagaaacgcacagaaatggagaaagaagcaaatattaaacataccaaagaaattaatggaataaaaattatgaattgcagatgatttaaaaagccaaattttgcactttagaaaagataaaaattaattattattttaaaatttatttatatcacttttgccttctttttttttttttttgagacggagtctcactgtcgcccaggctggagtgcagtggcgcgatctcagctcactgcaagctccaactcccgggttcaccccattctcctgcctcagcctcccgagtagctgggaccacaggcgcccaccaccaggcccggctaattttttgtatttttagtagagacggggtttcaccgtgttagccaggacggtctggatctcctgaccttgtgatccgcccgcctcggcctcccaaagtgctgggattacagacttgagccaccgcgcccggcccacttgtgccttctttccatacaatgaaaggaacatagaatgcttgaacttcatacatctcttctaaaaataaattcttggagagaaaaaacagaacaaaaagagaagacacagctagtatcagtaattacctggttctgtttcagtcaactggattctgaagatgaaaaaaaccttgaactcatataaaacacaaaaattatttccttgtggtatgcatacatgtgaaaggaaaataaatggtttatgagctattatttttaaagccttcataacactgggataatgaataatattttcccaaagtacacaaaaatttctaacccaaatgaaaagattaaaatgtcagattatataaaaattgagactgttataaatactttaagaatgtgaagagcaagccataaaaaaaagcagtaaaagagataaagacctactatcagtcagtaataaagacaaagacaacctagttaagaaaaagtcaggacattatgaaggatacattctgaataggcaataaacatataaaaagtttttaaagttagtaagaaaaaaatataaattaaaacccaaacaagaagccacatgcttaaaattcaaaagcttgacaagaccatttattggcaaagatacgctacaactattcagcattatttattaaaatcaaagatactcataatctataacaattccactctatgtaaccaacagatgtaccttcacatatgcattaatatatgtgttcaaaatgttcatagtttgaacacattagcctcaaataggaaacaatacaaatgcaccacaataggagaatggaaaaataagttgtgatatgttcatacaatgaaatactatatgacaataaatgactgtttttacacctgacaatgtggattgatagcacaaacatactaataatctaaaaagccagaaacaaaagcctacataaaatatgagtaagttcatatattttttcacaaaggtgaaatctaaactatagggttttgggagtcatccttagaagataaagaatgaaaacaggccgggtgcggtggctcacgcctgtaatccaagcactttgggaggccgaggcgggggatcacgaggtcaggagttcgagaccagcctggctggcatggtgaaagcccatctctgctaaaaataccaaaaattagctgggcatggtggcatgcacctttagtcccagctacttgggaggctgaggcaggagaattgcttaaacccggtaggcagagatcacagtgagcggagatcatgccattgcactccagcctgggcgacagagccagactccatttctaaaaaataaaataaaataaaataaaataaaataaacaacagatgattttatttaaaaaaaaaatgatgggttagcgattaggggacagagagacacttgtggctgggtaagggcacactgggagctcccaggtgctatttctttacattagtgtggtagccccatggctgtttgctttataataattaattagcctataaatttatgtttaatgttctttttctgcatgtgtcttatattttacaataaaaggaaaattaaaaagtcatagctgctctccccacccttcttgaaaccaagagaatgaatgatctaagcagaccaagctgccccccacccaatctgataaaagggaaatgacatgcctgaatcaagggctgcttcaaagttaatgacaaatttcttttatccctcctgattcctaagcagtcctgttggtttgagtctccttcagtggcaggttggagaaaatgacagttccaaactggaaacccctagtcttggaactccatgtcgagttcatatatgaggaaatttcacaaatctctgacactgttaaatttttttcttgttttaaaaactttttggtcttatttaggaagcatgcccttccttgcgtgaatttcacaggctaagaagatgatgggattttaagacagactggctagcataccctcaccattgtcccaatcaagtcaccattgtcccaatcaagctttcctgaattctagggacctgtcatgaagtcatctacattgtcctttgtctttccttacccattaaatagtgctcttctcccctccctccagcctcagtgtacatgcccagtgttctcatgtgctactaacaactcattagaggttctgttacatcctagaactaagtcaggttgcagcagctaaacccttactgtcagaaccatctatttatctttgttttatgctaaatctattactgatgtctttcatgagttcactgtgttgtaggaaatcttttgtgccccagattaaagcattgttatcttatttagcaacacaattttgtatcaaatcacagtcctgagtattctgagcttgctagcccttttcactgttaaggcttctctgagttatatgccggtaatgggctcagaatctgtacattcaccagtggtccaatgatctacagggctacataaacccttgaatcaaagctatgtgtttcatgtcactctgactcaaactgctccagccaaggcaacttagttgttagatttttttccagttagtgaatccagcaccagcaggtcttagaaattatgaccaaaagtgaaagcaaatcatcacactgatcgaaaaggatctgtaggacttggcttcctttgctccgaagctccctcttacacattagacttcagccacgctggcttcttcgccgagcgtattcgcacaaatatccactggggtcaccgcctcacatccttcacatttgtgctccactccaacttcttcaagtggcaaattcctaaaccaaataacttaaacatgcaactaccaccctcactagacccttcctgtcctcttgttctacttaactgttctccatagcacttattattatttcacatactctgtatttacttgtttattatggtttccttccactataaagtattttcgactgcaaggaattttgctctattcttttttctttttattttattttattattattatactttaagttttagggtacatgtgcacaatgtgcaggttagttacatatgtatacatgtgccatgctggtgtgctgcacccattaactcgtcatttagcattaggtatatctcctagtgctatccctccccccttcccccaccccacaacagtccccagagtgtgatgttccccttcttgtgtccatgtgttctcattgttcaattcccacctatgagtgagaatatgcggtgtttggttttttgttcttgcgatagtttaccgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttaagcagcatgatttatagtcctttgggtatatacccagtaatgggattgctgggtcaaatgctatttctagttctagatccctgaggaatcgccacactgacttccacaatggttgaactagtttacagttccaccaacagtgtaaaagtgttcctatttctccacatcctctccagcacctgttgtttcctgactttttaatgattgccattctaactggtgtgagatggtatctcattgtggttttgatttgcgtttctctgatggccagtgatggtgagcattttttcatgtgttttttggctgcataggtgtcttcttttgagaagtgttcgttcatgtccttcacccattttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttctcaattttggcttttgttgccattgcttttggtgttttagacatgaaatccttgcccatgcctatgtcctgaatggtattgcctaggttttcttctagggtttttatggttttaggtctaatgtttaagtctttaatccgtcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcggcattgtttctgagggctctgttctgttccattgatctatatctctgttttggtaccagtaccatgctgttttggttactgtagccttgtagtatagtttgaagtcaggtagtgtgatgcctccaactttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttcttcttgaagaggtcattcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagaaaatggggttttctagatatacaatcatgtcatctgcaaacatggacaatttgactttctcttttcctaattgaataccctttatttccttctcctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaaaacttttctgcatctgttgagataatcatgtggtttttgtctttggttctgtttctatgctggattacatttattgatttgcgtatattgaaccagccttgcatgccagggatgaagcccacttgatcatggtggataagcttcttgatgtgctgctggattcggtttgccagtattttattgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccggttcctccttgtacttctggtagaattcggctgtgaatccatctggtcctggactctttttggttggtaagctattgattattgccacaacttcagagcctgttactggtttattcagagattcaacttcttcctggtttagtcttcagagggtgtatgtgttgagggatttatccatttcttctagattttctagtttatttgcgtcgaggtgtttgtagtattctctgatggtagtttgtatttctgtgggatgggtggtgatatcccctttttcattttttattgcatctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttatgaatgtgtttgctcttgcttttctagttcttttaattgtgatgttagggtgtcaattttggatctttcctgctttctcttgtgggcatttagtgctacaaatttccctctacacactgctttgaatgtgtcccagggattctggtatgttgtgtctttgttctcattggtttcaaacaacatctttatttctgccttcatttcgttatgtacccagtagtcattcaggagcagattgttcagtttccatgtagttgaacggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaataaaatgtatattctgttgatttggggtggagagttctgtagatgtctattaggtccacttggtgcagagctgagttcaattcctgggtatccttgttaactttctgtctcgttgatctgtctaatgttgacagtggggtgttaaagtctcccattattaatgtgtgggagtctaagtctctttgtaggtcactcaggacttgctttatgaatctggatgctcctgtattgggtgcatatacatttaggatagttagctcttcttgttgaattgatccctttaccattatgtaatggccttctttgtctcttttgatctttgttggtttaaagtctatttcatcacagactaggattgcaacccctgcctttttttgttttccatttgcttggtagatcttcctccatccttttattttgagcctatgtgtgtctctgcacttgagatgggtttcctgaatacagcacactgatgggtcttgactctttatccaatttgccagtctgtgtcttttaattggagcatttagtccatttacatttaaagttaatattgttatgtgtgaatttgatcctgtcattatgttagctggttattttgcttgttagttgatgcagtttcttcctagcctcagtggtctttacaatttggcatgattttgcagtggctggtaccggtttttcctttccatgtttagtgcttccttcaggagctcttttagggcaggcctggtggtgacaaaaatctctcagcatttgcttgtctgtaaagtattttatttctccttcacttatgaagcttagtttggctggatatgaaattctgggttgacaattctttcctttcagaatgttgaatatcggcccccactctctcctggcttgtagagtttctgccgagagatccgctgttagtctgatgggcttccctttgtgggtaacccgacctttctctctggctgcccttaacattttttccttcatttcaactttggtgaatctgacaattgtgtgtcttggagttgctcttctcgaggagtatctttgtggagttctctgtatttcctgaatctgaatgttggccttcctcgctagattggggaagtcctcctggataatatcttgcagagtgttttccaacttggttccattctccctgtcactttcaggtacaccaatcagatgtagatttggtcttttcacatagtcccatatttcttggaggctttgttcatttctttttattcttttttctctaaacttcccttcttgcttcattcattcatttcatcttccatcactgataccctttcttccagttgatcgcatcggcccctgagtcttctgcattcttcacatagttctcgagccttggctttcagctccattagctcctttaagcacttccctgtatggcttattctagttatacattcgtctaaatttttttcaaagttttcaacttctttgcgtttggtttgaatgtcctcccgtagttcggagtaatttgatcatctgaagccttcttctctcagcttgtcaaagtcattctccagccagctttgttccattgttggtgaggaactgcattcctttggaggaggagaggcactctgctttttagagtttccagtttttctgctctgttttttccccatttttgtggtttcatctacttttggtctttgatgatggtgatgtacagatgggtttttggtgtggatgtcctttctgtttgttagttttccttctaacagacaggaccctcagctgcaggtctgttggagtttgctagaggtccactccagactctgtttgcctgggtatcagccgtggtggctgcagaacagtggattttcgtgaactgcgaatgctgctgtctgatcattcctctggaagttttgtctcagaggagtacccggctgtgtgaggtgtctgtctgcccctactggggggtgcctcccagttagtctgcttggaggtcgggggtcagggacccacttgaggagacagtctgcccgttctcagatctccagctgcgtgctgggagaaccacagctctcttcaaagctgtcagacagagacatttaagtctgcagaggttactgctgtctttttgtttgtctgtgccctgcccctagaggtggagcctacagaggcaggcaggcctccttgagctgtggtgggctccacccagttcaagcttcccagctgctttgtttacctaagcaagcctgggcaatggcaggcacccctcccccagccttgctgccgccttgcagtttgatctcagactgctgtgctagccatcagtgagactccgtgggcgtaggaccctccgagccatgtgtgggatataatctcctggtgggccgttttttaagcccatcgcagaagcgcagtattagggtgggagtgacccgattttccaggtgccatctgtcaccctttctttgac

SEQ ID NO: 12544 - DNA, 33965 bp, Homo sapiens
aactcccacttatgagtgagaacatgcagtgttcggttttctgttcctgtgttagtttcctgagaatgatggtttccagcttcatccatgtccctacaaaggacatgaactcatactttttatggctgcatagtattccatggtatatatgggccacactttctttatccagtctatcactgatgggcatttgggttggttccaagtctttgctattgtgaacagtgctgtaataaacatatatatgcatgtgtctttatagcagaataatttataatcctttgggtatatacccagtaatgggattgctgggtcaaatggtatttctggttttagatccttgaggaattgccacactgttttccacaatggttgaactactttacactcccaccaacagtgtaaaagcattcctatttctccacatcctctccagcatctgtttcctgactttttaatgatcgccactctaactggtgtgagacggtatctcattgtggttttgatttgcatttctctaatgaccagtgatgatgaggttttttttatatgtttgtcacataaatgtcttcttttgagaagtgtctgttcatatccttcacccaatttttgatagggttgtttgttttttttcttgtaaatttgtttaagttctttgtagattctggatattagactttgtcacatggatagattgcaaaaattttctcccattctgtaggttgtctgttcactctgataatagtttcttttgctgtgcagaagctctttagtttaattagatcccatttgtcagttttggcttttcttgcaattgcttttggtgttttagtcatgaagtctttaccatgcctatgtcttgaagggtattgcctaggttttcttctacggtttttatggctttaggtttgacatttaagtctttaatacatcttgagttattttttgtataaggcgtaaggtgtgaggaaggggtccagtttcagttttctgcatatggctagccagttttcccagcgccacttgttaaatagggaatcctttccccattgcttgttttggtcagatttgttggagatcagatggttgtatatgtgtagtgttatttctgaggcctctgttttgttccattggtctatatatctgttttggtaccagtaccatgctgttttggttactgtagccttgtagtatagtttgaagtcaggtagtgtgatgccaccagctttgatcttgatctttttgcttaggattgtcttggctatacagtctcttctttggttctatatgaaatttaaagtagttttttcttgttctgtgaagaaagtcaatggtagcttgatgggaatagcattgaatctatgaattactttgggcagtatggccattttcacaatgttgattcttcctatccatgagcatggaatgtttttccatttgtttatgtcctctcttatttccttgagcagtggtttatagttctccttgaagaggttgttcacatcccttgtaagctgtattcctaggtatttaatatactttgtagcaattgtgaatgggaattcactcatgatttggctctctgtttgtctgttattggtgtataggaatgcttgtgatttttgcacattgattttgtatcctgagactttgctgaagttactcatgagcttaaggagttttagggctgagacaatggggttttctaaatatacaatcatgtcacctgcaaacagagacaatttgacttcctcacttcctatttgtatatcctttgtttctttctcttgcctgattgccttggccagaacttccaatactatgttgaataggagtggtgagagagggcatctttgtcttgtgccagttttcaaagggagtgcttccagcttttgcacagtcagtatgatattggctataggtttgtcataaatagctcattattattattattttgtttattgttattatactttaagttttagggtacatgtgcacaatgtgcaggttagttacatatgtatacatgtgccatgctggtgcgctgcacccactaactcgtcatctagcattaggtatatctcccaacgctatctctccccactccccccaccccacaacagtccccagagtgtgatgttccccttactgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctattgttgttggacatttgggttggttccaagtctttgctattgtgaataatgccgcaataaacatacgtgtacatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattgtaactggtgtgagatggtatctcattgtggttttgatttgcatttctctgatggccagtgatgatgagcattttttcatgtgttttttggctgcataaatgccttcttttgagaagtgtctgttcatatccttcgcccactttttgacggggttgtttgtttttttcttgtaaatttgtttgagttcattgtggattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaatgtttaagtctttaatccatcttgaattgatttttgtataaggtgtaaggaagggatccagtttcagctttctacatatgtcttgccagttttcccagcaccatttattaaatagggaatcctttccccattgcttgtttttctcaggtttgtcaaagatcagatggttgtagataagcggcgttatttctgagggctctgttctgttccattgatctatatctctgttttggtaccggtaccatgctgttttggttactgtagccttgtagtatagtttgaagtcaggtagtgtgatgcctccagcttagttcttttggcttaggattgacttggcaatgcgggctcttttttggttccatatgacctttgaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagtcggattcctaggtattttattctcttggaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgagtaccctttatttccttctcctgcctaattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgaaatacgtcccatcaatacgtaatttattgagagtttttagcatgaaggttgttgaattttgtcaaaggccttttctgcatctattgagataaccatgtggtttttgtctttggttctgtttatatgctggattacatttattgatttgcatatattgaaccagccttgcatcccagggatgaagcccacttgatcatggtggagaaggtttttgatgtgctgctggattcggtttgccagtattttattgaggatttttgcatcaaagttcatcgaggatattggtctaaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattcagctgtgaatccatctggtcctggactctttttggttggtaagctattgattattgccacaatttcagagcctgctattggtctattcagagattcaacttcttcctggtttagtcttgggagagtgtatgtgttgaggaatttatccatttcttctagattttctagtttatttgcgtagaggtgtttgtagtattctctgatggtagtttgtgtttctgtggaatcagtggtgatatcccctttatcattttttattgcgtctatttgattcttctctctttttttattagtcttgatagcggtttatcaattttgttgatcctttcaaaaaaccagctcctggattcattaattttttgaagagttttttgtgtctctatttccttcagttccactctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaatatctttatttctgccttcatttcgttatgtacccagtagtcattcaggatcaggttgttcagtttccatgtatttgagcagttttgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattttgttgatttggggtggagtgttctgtagatgtctattaggtctgcttggtgcagagctgagttcaattcctgggtatccttgttgactttctgtctcattgaattgtctaatgttgacagtggggtgttaaaatctcccactattaatgtgttggagtctaagtctctttgtaggtcactcaggagttgctttatgaatctgggtgctcctgcatttggtgcatatatatttaggatagttagctcttcttgttgaattgatccctttaccattatataatggccttctttgtctcttttgatctttgttggtttaaagtctgttttatcagagactaggattgcaacccctgcctttttttgttttccgtttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccattttcatttatagttaatattgttatgtgtgaatttgatcctgtcattatgatgttagctggttattttgctcgttagttcatgcagtttcttcctagtctcgatggtctttacattttggcatgagtttgcagtggctggtaccggttgttcctttccatgtctagtgcttccttcaggagctcttttagggcaggcctggtggtgacaaaattcgtcagcatttgcttgtctgtaaagtattttatttctccttcacttatgaagcttattttggctggatatgaaattctgggttgaaaattcttttctttaagaatgttgaatattggcccccactctcttctggcttgtagagtttttgctgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcctatatttcttggaggctttgctcatttctttttattctttttttctttaaacttcccttctcgcttcatttcattcatttcatcttccattgctgacaccctttcttccagttgatcgcattggctcctgaggcttctgcattcttcacgtagttctcgagccttggttttcagctccatcagctcctttaagcacttctctgtgtgggttattctagttatacattcttctaaacttttttcaaagttttcaacttctctgccttcggtttgaatgtcctccggtagctcagagtaatgtgatcgtctgaagccttcttctctcagctcgtcaaagtcattctctgtccagctttgttccattgctggtgaggaactgcgttcctttggaggaggagaggtgctctgctttttagagtttccagtttttctgctctgttttttccctatctttgtggttttatctacttttggtctttgatgatggtgatgtacagatgggtttttggtgtggatgtcctttctgtttgttagttttccttctaacagacaggacccttagctgcaggtctgttggagtacccggccatgtgaggtgtcagtctgcccctgctggggggtgcctcccagttaggctgctcgggggtcaggggtcagggacccagttgaggaggcagtctgccagttctcagatctccagctgcatgctgggagaaccactgctctcttcaaagctgtcagacagggacatttaagtctgcagaggttactgctgtctttttgtttgtctgtgccctgcccccagaggtagagcctacagaggcaggcaggcctcctagagctgtggtgggctccacccagttggagcttcctggctgctttgtttacctaagcaagcctgggcaatggcgggcgccccttccccagcgttgctgccaccttgcagtttgatctcagtctgctgtgctagcaatcagcgagactccatgggcataggaccctccgagccatgcgcgggatataatctcctggtgcgctgttttttaagcctgttggaaaagcacagtatttgggtgggagtgacctgattttccaggtgccgtctgtcacccctttctttgactaggaaagggaactccctgaccccttgcacttcctgagtgaggcaatgcctcgccctgctttggctcacgcatggtgcatgcacccactgacctgcacccactgtctggcactccctagtgagatgaacccggtacctcagatggaaatgcagaaatcacccatcttctgcgtcgctcacactgggagctgtagaccagagctgttcctattcagccatcttggctcctccccacctttcctgactttttaatgtttgccattctaactggcgtgagatggtatctcattgtggttttgatttgcatttctctaatgaccagtgatgatgagcttttttgcatatgtttgcgactgcataaatgtctttttttgaaaagtgtctgttcatatactttgcccactttttgatggggttgtttgtttttttcttgtaaatttatctaagttctttgtagattctggatattagccctttgtcagatggatagattgcaaaatttttctcccattctgtaggttgtctgttcactctgaaaatagtttcttttgctatgcagacactgtttagtttaattagatcccatttgtcaattttagcttttgttgccattgcttttggtgttttagtcatgaagtctttgcccatgcctatgtcctgaatgatattgcctaggttttattctagggtttttatggttttaggtcttaggtttaagtctttaatccatcttgagttaatttttgtataaggtgtaaggaagtggtccaatttcagttttctgcatatggctagtcagttttcccatcaccatttattaaatagggaatcctttccccatttcttgtttttgtcagggttgtcaaagatcagatagttgtagatgtgtggtgttatttctgaggcctctgttctgttccactggtctatttatctgttttggtacgagtaccatgctgttttggttactgtagccttgtagtatagtttgaagtcgggtagcatgatgcctccagtttgttctttttgcttagtgtgaaaatggccatactgcccaaagtaatttatagattcaatgctatccatatctatttgttgtctttatagtaatttgacgtgtaaagttaggttgcttatttgagattgctcttcttttttttctagttttattttgggttaagggggtatatgtacaggtttgttacatgagtacagtgtgtgtcactgaggcttggtgtatgaatgatctcatcatcaaggtagtgagcgcagtacccgataggtagccttccaacctctcccccttcccaccctccccactcaagtaatccccagtgtctattgttcccatttttgtgtccatgtgtattcaatgtttagctcccattataagtgagaacacatggtatttggttttctgttcctgtgttagtttgcttaagataatggtcttcagatgcttccacattgctataaatttcgttcttggaactccttttgctgtatcctgtaacttttgataaattatattttcatttttacttctctcaagatagttttaaaatttctctgatttcttcttttacccagtgattattcaagagtgtgttagttttcatgtattcatgaaatttcccatttttattgcttttattgatttctagcttcattctattgtggttggatagtatatctggaatgatttcaatcttcttaaatttgttaagatttgctttgtgacctgaaatgtgatctattctggagaatgttccatgtatgaatgagaagaatatatattcttctcctgttggataaaaagttctgtataaatctattaggtccatttgccctatagtgtagttcagttccattgtctctttgttgattttatgtctgatgtcctattcactattgaaagtaggatattgaagtcttctactattattgtattgctgtcaacctctccttttcaatctgtcaatatttgctttatatacttagatgctctgatgtcggacacatttatatttagtattgttatatgtttctgttaaattgactcttttaccattatgtaatgatcttttttgtatctaaaaacagtttttttttttaactgaaactctgctttatcttatataagcagagccattcctgctctcctttggttactgtttatatgaaatatcctttctcatccctttcctttcagcctctgtgtgtccttaaatctaaagtgagtttcttgttgacagcagatagtttgatcttgattttttttatccatttagtgactctatatcattttattgggaagtttagttcatttgtttaaaataattattgataaggagggatttattattaccatttgattaactgttttctctttgtcttacagcccttttgtccctatttttatctcttgctctgtttcatttttaattaattggttttgatttctttatgtttttcttttgtgtaacttctataggtgttttctttgtggctaccaaggagcttacataaaatgtcttatagttgtaacagtctattttgagctgataataacttcatttgcatacaataactgctttgatccctcttccctccaaattatattctgttgatgtaacaatgtacatctatttgtattatgtgtctattaatatcatttatagacattttaatgttttttccttttagcttttatagtagaattaaaagtgatttaccacctccattatagtaatacaatattctatttttgtctatatttacctttaccagtgagcttcattccttcttatgcacgtgtgttgctgtttagtactcttttaattaaacttgaagagctctctttagcatttcttgtaaggtaggtctagcagtaataaactccccgagcttttgtttttctgagaaagtcttaatctctttttcatttttttaaggttagatttgcttgacacagtattcttgattggcagttccccactcccagcactctgagtatatcattccatgcacttcttacctgcaaggttactgctgaaaaatctactaatagtcttatgaagattcccttgtatgtagtaggttgcttttctctttctgatttcaaaattctctgtctttaacttctgacaatttaattataatgggtctttttggattcactttatttagtatcctttgggcttcctggatctggatttctatttactcccccaggcttgggatgtttttagctattatctcttggaatatattaggttggtgcaagagtaattgcgtttttttgcagatgtattgcaaaaactgcaattactcttttaccaacttaatactttctttcactttcttttttctcttcttttgggtctctaataatgtatacattggtcggctttatgtgtcccataagtcccttaaggtatcttcactctttcattcttatttctttttgctcctctgattggatgatttccaatggcctgtcttcaagttcactgatgctttcttctgcttggtttagtctgctgctgaacttctctgttgaatttttcagttcaggcattgtattcttcggctgtatcacttctgtttggtatgtttaaacattttctatctgtgtgttgaaagtctcactttgttcatgcctttctctcctgacctcagtgaatatttttaagaccattattttgaattccctgctgggtaaatgacttgtcactattttattaagttgacttctggagttttatctttttttgttttgttttgttttttgttttgttgttgttgttgttgtttgaaacgtattttcctgtttcttcattttccttgattctgtgttggtttctgtgcattagataaaacagctacctctccagtcttgtgtaggaataaaccacacaaatcagtatggccagtgattctgggtgcctcccaaatctttgtgcttgtccaaaccattgcctatgttcttcatgggccccagaagattaatgtgttccatatcccattagtgccctgagacaattcaaaaagaagtgaatactttgagaagaagctggaaaatttatggtgctagatgtgtggtccagttttttttttctctcttcagggagaagcttggaactgaagtgtatttgcccttgttctggaataaggcatggagactatctgtgtcagattcctgcactctcgttcagactgtacactctttcaaccctttggtctgctctttgtttccctcaggggcctaatgaatattgattcccattggctgtcagagacaggtgagtcagatggaggcttggtactatctctagagcaagctgagaagaggatttgtgggaagtgcctatagttcccttcaggctcccagagaagtacttattgcctgccccatcagctcccagatgcaggctaattaaaggcttgatcctgggaagcagcagtgaaagttaagatgttaggtttgcagttgaaccccttccagggagaaactggaaactgggtgttttgccttcttgttctgtgccgagccaggggaagtagccactacaggtgctcctattcccatttaaaatcaaatcaattctttgttctctgtggtctggggggacttgtaaatgctaagtcatgtcagttcccagagataagtgatttaggagctagtctctcaagtgggagctgtacaagttggggtgctcaatgtgtagacaagccccttccaggcagaagctggaggcttggttttactgctggagtaatatggtgggggggggggggaagattgctaattagctgcatttaaaatagattattttggattgtctgggtacccccagtgtaatcacaatggcccttaaaagtggagagagatgcggaaaagaagttcatagtgatttgatgtgagaaggactcaatccattgtcattggctttgaaggtggaactgggccataagccaaggaatgcaggtgatctctagaagctgcaaaaggcaaggaaattgattctccagtacagcctccagaaaagaactcatcctcaccaacaacttgagactcatgttgaacctctaagttccaaaactgtaagataataaatttttgttgttttaagctactaaatttatggtaacagcagcaacaggaaactaagcatattggacttgaaaatgtgtattctgctgttattaagtggaatgttctataaatgtcaattaggtcaaattggttgacaatgttggcacactgaataatgcccccaaagatatccatgtcttattgcccaggacatacctgtggatgttactttatatgtcaaaaagggacattgcagatgtaattgagttaaggatcttgagataaagagattatttttgattgtccagatggactctaaatataaattttaagagaagcagagggaaggcacagaaaaagagggcaatgtgaggactgaagcaagatgctgtgctgctggctttgaagatgaaggaaggggccatgagcagctctaaaagctgcaaaaggcaaaaaaatatttcccttagagattttggagaagtagggcactaccatcaccttgatttcagccccatgaaactgattttggactgttgatttccagaactgtgagagaataaatggcttgtattaagacacgaagcttgtaggaatttcttgcagcagccataggaaactaatacaatggtgttcaaatcttctctatctttactgatttttttgtctacttgtactattattattatttttccatacctatcttctatactattaattattgagaggggcattaaaatctctggccatatttgtgagtttttctttttattattgcaattctgtcaatttttgcttcatgtgttttggaattctgttattacacacataaaagttttagattgttatgtcctcttgatgaattgatggctttatcattgtagaatgtccttcttcattcctgataatattttttcctttgaagtctactttgtctgatattaatattgtcattccaagtatcttttgattagtgtcattatagaatatcttttttcatccttttctgcttaagccagctgtctttatatttagtgcaagattcatgtaggcaaaatatagataagctttgctttttaaatccactctgacaatcactgccttttaactgaggatattcagaccatgtactctaatatttagattattgacttctttagatttaaatctatcatcttactatttttcaaatttgtcgcatttgttctttgtttccctttttactgccttcatttatattaattgaacttttaaaaaattccatttttcctctctctgttggcttattatctataactctttgttattttattggttgacttagagtttatagtatagagcttttgcttgcctcagttcaccttgaagtgatatcatatcactttacatagagcataaacattttataatagtatctttccatttttcctctcctgattttttgtcctattgttctcacaggttttacttttgcatatattgcaaaactcaatctatattgttattatttttgtttaagcagtcaattatattttaaaggtatttaattaataagaaaaataccctatatatttactcatgtggttaccatttttgatgatcttaattcctttgaaaagatcagtatttttctctgatatcattctccttttttaacttttttttttttttttgtagttcaggtctgctggcaacaaactgagctactgaatgtctggaaaagcttttattttgccttcatttttgaaaggtaattttgaaaaataattttaatttgacagtttttcttctaatacagtcatgtgtcacataatgatgttttggtcaacaacagaccacatatgcgatgttggtcccataagagtatagcaccctatttttactgtattttttttctgtgtttagtatgtttagatacacaaatacttaccagtgtgttacagttgcctacagtattcactacagtagcatgctctacaggtttgtagtctaggagcaataggccatatcatacagcctaggtgtgtagtaggctgtaccatttaggtttgtgtaagtacactctacaatgttcacagaatgatgaagtagcttaatggtgcacttctcagaatatatccccattgttaagtgacacatgattgtactttgtaaatgttgtttcactgtcttctctgtcacattaattcttcagaaaaatctgttgtcatccttacctttgtttctctggacataacatatgttttttttcctctggctgctttaagaattgtccttttatcattcattttgatcaacctgattatcatgtttcttcttgtggatgtcttatttgcttggggttcactgaacttcttgggttcttgtgcttacagttttcataaaatttggaaaatttttggccattattgattccaatattttttctgtcctgacccccttttatttttagtgaatccagttacatatacattccacttgaggttgtcccagagctcactgaagctctgttctttgaaagtgactattctttttttcttttgtgttttctatgttgggacatttctattgctgtgtcttcaagttcattaatcttctctcttttctaaatttttaggttcaggggtaaatatgcaggtttgttatataggtaaacttgtgtcacaagggtttgttgtacagattgttttgtcactcagatactaagcctagtacccaatagttgttttttctgttccttttcctccttccatcctgcaccctcaaataggccccagtgtctgttgttctcctctttgtgtccatatgttcttatcatttagctcccacatgagaacatgtactatttggttttctgttcctgcattagtttgttaaggataatggcctccggttccattaatgttcctgcaaaggacatgatctcattcttttttatggctgtgtagtattccatagtgtatatgtacattttctttatccagtctagcattgatgggcatttaggttgattccatgtttttgctattgtgaatagtgctgcaatgaacatacatatgcatgtgtgtctttatgatagaataatttatattcctttgaggatatacccagtaatgggattgctgggttgaatggtagttctggttttagatctttgaggaattgccacactgctttccacaatggttgaactaatttacactctcaccaacagtgtatcagtgttcccttttctcagcaaccttgccagcatttgttattttttgactttttagtaatagccatttggactgatgtgcgatagtatctcattgtagtttattttgtatttctctaattatcagtgatattgagcttttttaaaatatgcttgctggccacatgtatgtcttgttttgaaaagtggctattcatgtcctttgcccactttttaatggggttgcttttttttcttataaatttgcttgagtttcttacagatgctggatattaaacctttgtcaggtgcataatttgtaaaaattttctcccattctgtaggttgtctgtttactctgttgatagtttcttttgctgtgcagaagctctttaattggattctatttgtcagtttttgcttttgctgcaattgcctttggcatcttcatcatgaaatttttgccagttcgtatgcccagaataatattgtctaggttgttttccagggtttatatagtttttgggttttacatttaagtctttaattcatcttgagttgatttttgtatatggtataaggaaggggttcagcttcaatcttctgcatatggctagcctggttagccagttatcccagcaccatttattgaatagggagtcctttccccattgtttatttttggcagatggttgtagttggtgtggccttatttttggcctctctattctgttccattggttatatgtctgtttttgtaccagtaccatgctattttgcttactgtagctctgtagtatagtttgaagttacgtagcatgatgcctccagctttgttctttttgcttaggatcaccttggctattaaggctgttttgattccatatgaattttaaaatagttttctttctagttctgtgaagaatgtcattggtagtttgatacgaataagattgaatttataaattacattgggcagtatggtcattttaacaatattgattcttcttattcatgagcatagaatgttatttcatttgtttgtgtcatctctgacttctttaagcagtgttttgtagttctcattatagagatctttcgcctccctagttagctgtgttcctaaatatttattctttttgaggcagttgtgaatgagattgcattcctgatttagctttcggcttgactgttgttgttatataggaatgctagtgacttttgtacattgattttgtatcctgaggctttgctgaagttctttatcagccgaaggagcttttgggctgagactatgggattttttagatataggctcatgttgtctgcaaacaaggatagtgtaaatttctctcttcccatttggaagagagaaacaaactctcttttgttactctcttttatttctctctcttatctgattgctctggccaggactttcaatactatgttgaatggaagtggtgaaagaggacatccttgtcttgtgtcagttttcaaggggaatactttcaggttttgtccattcagtataatgttggctgtgggtttgtcatagatagctcttattattttgaaggtatgtttcttcaatacctggtttattgagagtttttaacatgaagggatttttgaatttgattgaaagccttttctgcatctatttagatgatcataagttcactaatcttttctttttcagcctaatattttgctaaccctattcaatgtacttcttatatcttttatggtagtttttatctctagaggttaaatttggatctttttaatgtcttccaccttactacttaaactgttttaacatatagcacacagttgtaataactgtgttaatgtttttggctgataattctaacacttttgtcagtctgggctggtatttattcattgatttatctcttcatattttcttgctaattttcatgtttggtaattttttactggatgccagacatctggttttgaccttcttatgtgctgaatattttcttacttctgtaaatattcttgagctttcttctgggatgcatttaagttacttggaaacagtttgatccttcaggtcttgcttttaatatttggtaggcatacttgataagttgtcagtctagaaccaattatttcccactagtgaggcaaggctcttctgggaaatctacccaatgccccacaaatcacaggcttttttagtttttatggtccgtggtgagtgcaggacactgtttcctctaatcttgttgactggttctttttgtcacctcagggggtttcaccacatgcatgtggtgatcagtattcaattgaagactcaagggggactctctgcaggtgtctagttttctctccatatagctctctcctctctcagactctgttatgtgaactcttagccacctttgtatctccagaatcccaactctatcttctcaaatcagggagtctgccaggctccacctggtttccataaatgttagttttttaatgctgcataacaaattaccgcgaacttagcaacttaaaacagcatagatttattatctcaagattagtgtgggcagggagtgtagacatagcttaactgtatgttctctgctttagggtttcaccagcctgtaatgctagcttaagtctaatcagaggcttgatgggaaagatctgaaccctcaggatgttgacacaatttgtttctttgtggctgtgaccaaggattttgactttttcctgtatgttggctagaggccacctgcagttctctgccatgttagccctgttcataggcaattcacaaaatggaaatttgctccttgaaggccaggaggaaaggaaaagcaagtctttgtgcagctatataaatcactggagtgacattctgtcacctatgccatgttctattggttagaaataggtctcagatcccacctacaatcaaggggaggagttctacaaaggtgtgaacaccaggggccaggaatcatttgaagtcaacatagggtctgtctgttataccctctctgtgttgtgacctgaaaactctctcaagacaggaggctgggaaaattgaaactcttgtcttgttttccaattctcagtgattactctcttttgttacctgattttcagtgtcttcagcactgtcattttatatcatttgtccattttttgattgtttcacatggggcaggaaggggatatctggtccttgttatgctattttgatctgacaaggaagtctgaactctgttttttaaattcagtttttctgtctgttgtcaggatatggaagtgttgtagcttttaaaaagttgatattatattgagattcattgctctacttttattacctttaattatctatctaaaattattatttttctttctcatcagtactcataccttttatttttatttctttttttgaagttattagatagataagacctgtggtaaaatgctaaatagaagcagtgatagtctgcatcttttgttgctccaaattttaatacaaatccctgcaatgtttgagagaaactctcttttttcatctgtccacttttagatgttttccagtatctttacatagatttaaaatttttaaaagtttttataactgctacccatggaggagtttatgtaatgaatacacttctccaacactaataggagtattcatcattaactttaaaaaaatcaattataatttgatttattaaaatttcatgagttttttcaaatacagctcatcatctttggtagttttttgttcctttttaatttgggctgtatgtgtgtgatattctaagaaatattttatagctacttagtacactgtaactagtactgtgatattaaagtttctgagtctacttctgttgggttttttaatctttttgatcttgttcatagggacatgatttgggttcactttactgaattaattccatctgaatactcaagtaaattggagatgttttcctctagagaagatttgtgtttgcttctactggctgtcaataattcaactaattttggataactttagtctcctggaaggtcctaaattaatacagaacactccaaatcagctctccaattttactgacagcccaagattgatttcttcatcttaggattggtaccggcatttgtctatcggtcacctctgccttccttgttcatgtattcctcatgggcctcaactccagtttgtgctcctcatttaaaaaaaaatattgtttgctctacctttggaattttctttatttttctggtgaactcatcaattataaaaattctgtttcttttaataaatgtagcctctatttgcatctagcaagatgatgcttcagaatatccagtccaatttgctatcttttctgacatttgtctttacttatgtttcagtgataaatctgtaggacgtcagggctaaaatctggctaacatgagtcatgtccacttaccattttctaaggagaaaactatagaagagaattaacaacatatgatcaaaggaactttacagtttatgtaatattattttattgccattttcattatattcagtagaaatagtagtactagaaagaagaaaatgagattttaggaacataaaactggctttagatatttgaaaatgagaggaattttatgtttacagatttcaaaaggctttgatattatatttcaatgcaaacagtaacttatcgtatgatttggttcattaataattggagtgatgttcagatttaaacatttcatagaatctcaaatatgacttcaggtaccacattttacagggaaattactgtgattcacccactaaatgatagtgagtaaataataactgggatctgtaactataacctaggagtcttgcgttctagtctaataactgttctcaaaaatatcattaactttttgggtataataaacagcaaactgcagaataaattgcacatactaaagagtaagcaacaaaacaaattgcacatgctgtgcagtatgcaaagccacagaattatcaatctgagaaacaactgaatacaaaataaaacacacagttgtgttttgattaaggctccttttaggcagtttgcttcagccaaggctgtgtaacttctttgagtttccatgtactttataaggctctgtttgaattcctttactctttcatctgatcccacaggtccacatttagacctctgtattaggctgtacaacccattggtatagtgatcaccatttttctccatcaacagatcctcaatacagtccattagttccttcacttggtcatcctgattgctcccttcagcacggttattaaaggcacagattcgcccaccacatgctgccaccagcttgcttagggctttgttatctgagtcgtgcatgtaatccatcagggagccaccattgaggtcttccttgtgggtaaagaggacaattgtgtgtcccatggcatcctctccaaagatctccttcaccctctgtgcagcctgctggtcctgtgaggtatagcggcccagctgagtcaccaggagcagcacatggggtcctggtgcagacagcaagtagcacctctgcacctctttgtacagagcttcacagtggtccttccaagaaaacatatctggtgtgtcaataatgacaatctctctatttccccagcttccctgacttttgctgcaagtcttagtcaaggtctgggaacccagcttcgattcaaatgcttgcttcctgaggatgctgttccctgcagcacttttgccagttcctgttttgcccaccaggatgattctcagctcagatctgctggcacattggccctttgcatgtggtcctgtgaggagcaagtttactgtgttatcgctacactgatcacggcagtggaatatttttttttcctttcatttctttttcttttttttttgagacggagtctcgctctgtcgcccaggctggagtgcaatggcgtgatctcgggtcactgcaagctccacctcccgggttcacgccattctcctgcctcagcctcccagtagctgggactacagatgcccgccaccgcatcccgctaattttttttttttttggtagttttagtagagacagggtttcaccgtggtatcgatctcctgacatcgtgatccgcccgcctcggcctcccaaagtgctgggattactggcgtgagccaccgggcccagccggtagtggaatatttttaatgataaggaggtattccccgttatgtaaaaagatactcgcacatctatttcacgtgaaatgaaagctaacttgattgctgtaggactgcagggtattgccatgttggagcctaggaaaacatacttggggatgagatggatttagagacatttctcatcatgtaatggttgcctgaatcactcagtcctggatctctagaagaaaagttttctggagatcagagatgcgtaggcaaggccatgggttccatctcaatgtgggccaagtgacctggctctgtttcaaggccagaggttgctactttgaccttggctgggcagagtggggtcatgactaccagggaagtggctggaccagcaaaatattagaatgagcagtgtaaaattatttttattagtgaagaaacaactgatatcttataaaggatatcataattttgcttagaaagcatggcataattttggtataaaatagtcacagaatatggtaaactttcctctctccttccccatttcccttcaacgtgggtaaggttctggggagaggagtgaatggggacagaggtatgaaggagcttgaggctttagggaaaaaatgtgtttcagacacataaaaggggaaggcataggagccatggtgccatttcgctggtccacatggcagtgataagaatgacttgtctagggcaggttcatggaagaaccaagatgcagctttgtagtggagagaggagtgatttaacttgcaaggcaagggtgactctggctcttgagggttaaccccttgattcctttactgtaagggaggaacatttgacctatatgagtgaaacggaataccatgataacaggagaatctttctggagggaatatccaaacaaactaagactctcctgctaagctcattgccttttgcggtttagctgttccttactctcatgttgcagagagaaagttggagaaggaaagtctacattgaccacagaatatcagagcttagaaggaacttagactgtacaaagaaaatgagctttctgagaggcagcatgcagtggtgaagaaaaaaagaatctggagctggattgcttagtttagattgtctttccattgctagtcatatgatcttggacaactgattaatttctcttcatctggagaagatgatggtttactccatgtggtggtgttctaatgactaaataagttaatatatgtaaagaacttaaaagagtgctggtgcacttaagcacttggtgaaaattaggctaggattgtttatagcaacctccttatagatgaagtaacttgcatgcaggggttaagtaacttggacaaagtcacctaaatagttagtgaaatctaccctttattgagcacttttaatgtgccaggatctgttccaagtggtttacctgcattacctaatttactcctcctagcaatgatatgatttagggttaggtgctgcaatgcccaccagtggtcttgttcttagctggttcaaatgacctctcgggctcacaggactgccatgggcctcactgggacactagtctactcagaagaatggaaaacttcgcttgccagagggacaatgttgggccttccacctagtggaagtctatgcagcaattcatggaacactgcaaactgtcacctagggaggtcccagggcaaggagatggcatcttgagcagttatagaagccacctggactcacaggagccaatgtctcttgtagcaactctggggtttagcttccagattccctgcaaggaacatgagagttacaagagtcactgtgctcagggaagttcaaaacatagcttcctagcatgtatttatagttcttccagtatagatataattcacccatcaagagaagttttcaaccataagcaaagttcctaataatgttagagacattttactcttattaaattattagagaatctcagctaaaacatttaaccaaagattaaattctcagaaagggaaagggtttgtcaacctttttacccatgggttccttttattcaccttattttacacataaatctgcaacttgcccaataacttagagcccattaaaagtaaccagttttgtaaatgaaaaagctggcatttgaacctgcccgttttctatgcctgaagtattagtgctttgccatgctgctacgccaacacttgttgcacatatttaagtattttctcttccagacaaattggccaaaatttatggacatttaatcttattttctgtaggccagtgaaattatggcctcacagtagacatgcaatggacacttgtacttaaaaggaagcaggcattacattacacatttctatattctgaaaacagcagccaagcagctcctgatacaccgcgctggagcttgcttagaggcagccaaattgcacgtttaaccttcctctcgcctatgaaaacagaaatgaagggagtcattgaagagaagcggtgggagtcctgagttgctggcctcctagggagtgctacctcattctctcccatggggagggtatagggaagagaattctctgcatccaaagccaagtgagagggtctctaaatcatccactcataaatattgggcatgtcaccaaagttgagagataggtaggtcatttcccagatgggtgtctgctgaatgacagaaactggtaagcctatccaagtgcagcaaagtgaagagaattcttgagcaaatttttgagaggagttagatgtaacctgaagtttggagacatgtataaacatggaaattggtgtctatttcctttctggagaattctaaattttgaaggctgactagagccacctaggagaccaggataaggagtaagcagcaatggcttagggggtttcccatggacagaagggatcttacagaaaataactaggcacagctgccttgatgaggccctgtccaaaggcctgccttgtatggcaagcggagtgcaattacaagaggaagccaggggtgccatgagggtgggagcagaggtctagttggagaattctgccagagagggcgcagcctctggcgggaagcctgcaacttagccctgtggcgactccacagtgttctcgcacagtggagggtgtctgctgtaatggggcatgggatggcggtgaggactagccaggagacaactgcaaggacaatgggactcaagcactccaccttctttctccagtcacccatcctcctgcctgatggggaaggagggactagcatgagggttgagggggcagagctggaagggagaggaggacttttggaaggtaccagagttcaggctgaggctgaggtagaggaaggagaaactcaaattgaatgtaagtttgatgttagacggcaccgaacagtacaacacctgatacatgtgtcatagtgactttaatagactattcttctagtctctattaatcagaaaggcaactgcctgagatggcatcaataaatcaagattgtggccgggcgtggtggctcacgcctgtaatcccagcactttgggaggctgaggtgggcagatcacttgaggtcaggaatttgagatcagcctggccaacatggtgaaaccctgtctctactaaaaatataaaaattagccaggcatgatgacacatgcctgtaatcccagctactcaggaggctgaggcaggagaatcacttgaacctgagaggcagaggttgcagtgagctgagattgcaccaatgcactccagcctgggccacagagccagactccattccctccaccccgcaaccaaaacaaaaggaaatcaagattgcataataagagtcagtggctgggaggaaaaaaaaagttgtttctcatttggatctcagagttcagcttgatcaataaacaagttccatacacaatgaagccagagacctcctatttctcacaggtgagggttgagtgtgaaggcaacttggtaaggaggaagatctgggctcttcttgatgtaagagactgaagacagggctgtcgaggggcagagagtgaggaggagggagtgggaaaggggaggtcaagatacagagagagagacgcccataccatacagatagcagaaacaggtgcaagaagaggagagagagagaaaggacaagggaagagaagggaatgatagagacagacagaaagacagagagagagacacacacacacacacacaaagaacctatggaaatgtgagagaaggaagagaagactgaatggtaggagaaggagtatttcaaagagatctgaaagatttgtgcataagggaaaagcctggatgcatattttggatcctggtgagtattttaacaattttcgagccagacttggtggttcatgcctgtaattccagcactttgggaggctgaggcgggtggatcacaaggtcaggagtttgagaccagcctgaccaatatggtgaaaccccgtctctactaaaaatacaaaaaaaaattagctgggcgtggtggtgtgtgcctttagtcccagctacttgggaggctgaggcaggagaatcacttgaacctgggaggtggaggttgcagtgagccgagattgcgccactgcactccggcctgggtgacagagagagacactgtctcaaaacaaacaaacaaacaaacaaacaaagaaaacaaaaccccacaattttcagctgctggtggtggtagctgtgggagttagaataagatccttcacccttgtttattttgccccaacatcatcagaagagccaaacacacacacacacacacacacacacacacacacacacacacacacacacgtgaagtcaccttcttaccccagtgactgtgttcattttggtccattggtgttcctgagaaacagagagacaagaaacttatttttcagttctaaatcatgaaaaattcttatatttcttttcttttctttttctttctttcttttttttttttttttttttgagacacagtttcactctgtcacccaggctggagtgcagtggtgcgatctcggctcactgcaacctccacatcctgggttcaagtgattctcctgcctcagcctcccgagtagctgggattatgggtgtgcaccaccatgcccatctaatttttgtagttttagtagagacagggtttcaccatgttggccaggctggtctcaaactcctgacctcaaatgatccaccagcctcggcctcccaaagttctggaattaaaagcgtgagccatcacactaggccaagatccttatatttctaaacaaccatgtttcatttgtctactcataagggacaaggtgggtgggaaaggaatgacttcctactttacagagaactggaatcacttgctgaggggctgagaagtgggtttcatttgtaagcctcatgcccagctctctctcgctttcttcctcccgtcctctcacagatcagcccggctcccttctgtttttgttttgcctgcacactcttcgcttctgtcagctttctctgtaggtgtgccttcccttacaccttaggctcagtcctccctttccctctctttcttttcccaccttgcctccttccctcctctactctctccaaacctcctccctcatgttgagtctttgctgagagactcagtgaatgaagattatgactctgggaaaccgtgcagtcctttaagctggaaatacacttcacttgatccattaatggcttgaatttttctcattccccaacagcccctggttatgaagcccttgcaatgtaggaactactatggagtgagaaatatcggtacgttttcatcagctagtttctcttgcttaaatctggcaggcatagaccaagcgtacaagcacagaaaactgaaagccaccgattaatgcccaaattcttcccagttagcactttttattgactttatactatggaaattctttctttgccagtaatgtgtaaagtaaattacatcggtttcctgtaaactggctccacttaaggaaaaggcagtcactctaaattgcttctcttaaaataggacaaatttgttctaagaaaaatgaaaatgtttgtgcatggcttgggacctagaaatcaacactgcagaacttttcgtaaatctgggcttacctgatttactgttcaaagaaacagttggctccctgttcagtcctgttgtcttatagctcagctccaagagaaaaagaaagtaaaaccgagactccagtcggtcttcttcctctcttgaatcttcctgagcttcctgactgctaatgaacgccaccacgtgcctgtgtttgaaattctctttcatgccattatgcaaaataaacagtttaaatggaaagttaatcagtagttatttgctgtcatgtgggccaactgtctcttcttctcaaaagtgaaaaaagagtgttttaatgatttcatctggactggaaagaaaggcatgaatgccaaggaagttggtggatttcagtccttcccagctgggatatgtcccaacagttagaagtttgtctagatgcaaatggccccctgagaagggcttaaacctcattgacaccagcagcagggattgttctaaagcagatgccactgggagagaagaggagcctctgataggcactgcccaggggaagaagggcacagaaaggggaacctgagaggggacatttttgtctgagtctgattgtaaggatcattaaccatcaaaacatttttacataactcattcatggcttctaggattctgggcctttcttccctgtccagctctgtaatttcagagaacctccctgtggggagaaattgtctaggaaatgtctatagtaatactctggagtgttggctgggtcaaatggtatttctagttcaagatgcctgaggaatcgccacactgacttccacaatggttgaactagtttacggtcccaccaacagtgtaaaagtgttcttatttctccacatcctagcatttaaaacatttccttttgattgtcttggagtttccaggtttatcatagactcagttgcaaatagtgataattttccctccttgtttccaaaaatatcttatgttgctttctcttgtataattacaattgcttgctaccttttcaaaagtgagttaatgtgcttttattatttatttacctgtagggcacctaatatcttatcattaatattgatgttggttattggaaattaattagtttattttaaaatcagtgtggctatactttgcttagtcctatttcattaaagtcttttatctgtggtataaatttagaaaattttattttgacgttgactgatataattccatgtctttttccttttgacctactaatattgcaaattacatcactgcgtttcctaacataagtgatatgtacatgtacatgtgcaaaggtttgggttcctaggaatacagactgttgagatgaagataaaatggatgaaggaagtttattagggaatcttctcaggaaatgtgctagagggagaagggaagaacccaggattaggcagggagaagtgagactgagatgtagtcacaacaaatatagactctacagggagttctaaagtttggttggactttcagaatgaaggagagtgagcagaactttataatccccatcggatgcaaacttcctctggaaaagacacttgacttacatagggcatctctcttcagcataagctaatttctggacaggtctgacggctcaacagctgagagctaacaactggtctcactcccagcaactggagataggtccttctgtttttgcactgttcctctaggtttggagatgcaaatattgcttctcctgcttcatcttttagatcatctgtagagacttccaagcacagttttaaatatctccctcatgaaatttcttgttcaagccttctcactcctgtcccttctgaacatgagcatacatggaacatttcccctatgtcccatggttctagtaagtgatgtgactacagccttaaaggaggagtaagatagatgttgggaggaggtgaggaaggagagggcaggggctgagtagaggtgcatgttttagagtactatgacattttaaaattcattttattcccatggttcaaggcaattttggaaaatgggtcaagccgaaagaatagaccacagatttcctgcagtcatattgagatgtatttgacaattgttctgtggtttcttgtaaagtgtttatttataaagcagtactgttcaatagagaattctgtgatggacatgtttactgtctgccctgtccaatatggcagccactagcacatgtggctgttgagcactagcaaggtggccaatgtgatggagaaactgaattttacattttaattttaaatcatataattaaacggccacatgtggctagtggttaccgttttgaacagtgcaattatagagtatatcattctcaataagatgatacaaaacattgtgtatgtaaaaggagggggtgcacaggtaaagatatgatgagaaattgcaaaacaaaaggaacaagtggatttaacatcccaaaattccaaaacatggggaggggaggcttgttactgtgaatttaaaaattgcggtgactttccccattgcttgtttttgtcaggtttgtcaaagatcagatagttgtatatacgtggaattatttctgagggctctgttctgttccattggtctatatctctgttttggtaccagtaccatgctgttttggttactgcagccttgtagtatagtttgaagtcaggtagcgtggtgcctccagctttgttcttttggcttaggattgacttggcgatgcaggctcttttttggttccatatgaactttaaagtagttttttccaattctgtgaagaaagtcatggtggggatggcattgaatctataaattaccttgggcagtatggacattttcatgatattgattcttcctacccatgaacatggattgttcttccatttgtttgtatcctcttttatttcattgagcagtggtttgtagttctccttgaagaggtccttcacatcccttgtaagttggattcctaggtattttattctctttgaagcaattgtgaatgggagttcactcatgattttgctctctgtttgtctgttattggtgtataacaatgcttgtgatttttgctcattgattttgtatgctgagagtgctgaagttgcctatcagcttaaggagattttgggctgagaagacggggttttctaagtatacaatcatgtcatctgcaaacagggacaatttgacttcctcttttcctaattgaataccctttatttccttctcctgcctgattgccctgaccagaacttctaacaccatgttgaataggagtggtgagagagggcattcctctcttgtgccagttttcaaagggaatgcttccagtttttgcccattcagtatgatattggctgtgggtttgtcataggtagctcttattattttgagatacgtcccatcaatacataaattattgagagtttttagtatgaagggctgttgaattttgtcaaaggccttttctgcatctattgagataatcatgtggtttttgtctttggttctgtttatatgctggattatgtttattgattttcatatgttgaaccagccttgcaccccggggatgaagcccacttgatcatggtggataagctttttgatgtgctgctggattcggtttgccagtattttattgaggatttttgcatcaatgttcaaggatattggtctaaaattccctttttttgttgtgtctctgccaggctttggcatcaggatgatgctggcctcaaaaaatgagttagggaggattccttctttttctattgattgaaatagtttcagaaggaatggtaccagctcctccttgtacctctggtagaattcggctgtgaatccatctggtcctggacttttttttggttggtaagctattaattattgcctcaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtgtttctgtgagatcggtggtgatatcccctttatcattttttattgcatctatttgattcttctcttttttcttctttattagtcttgctagtggtctatcattttcttgatcttttcaaaaaaccagctcctggattcattgatttttttgaagggttttttgtgtctctatttccttcagttctgctatgatcttagttatttcttgtcttctgctagcttttgaatgtgtttgctcttgcttctctagttcttttaattgtgatgttagggtgtcaattttagatctttcctcctttctcttgtgggcatttagtgctataaatttccctctacacagtgctttgaatgtgtcccagagattctggtatgttgtgtctttgttctcattggtttcaaagaacatctttatttctgccttcattttgttatgtacccagtagtcattcaggagcaggttgttcagtttccatgtatttgagcagttttgagtgagtttcttaatcctgagttctagtttgattgcactgtggtctgagagacagtttgttataatttctgttcttttacatttgctgaggagggctttacttccaactctgtggtcaattttgggataggtgtggtgtggtgctgaaaaaaatgtatattctgttgatttggggtggaaagttctgtatatgtctattaggtccacttggcgcagagctgagttcaattcctggatatccttgttaactttctgtttcattgttctgtctaatgttgacagtggggtgttaaagtttcccattattattgtgtgggagtctaagtctctttgtaggtcactgaggacttgctttatgaatctgggtgctcctgtattgggtgcatatatatttaggatagttagctcttcttgttgaattgatccctttaccattatgtaatagccttctttgtctcttttgatctttgttggcttaaagtctgttttatcagatactaggattgcaacccctgcctttttttgttttccatttgcttggtagatcttcctccatccctttatttggagcctatgtgtgtctctgcacgtgagatgggtttcctgaatacagcacactgatgagtcttgactctatatccaaattgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggttggtactggttgttcctttccatgtttcaggcttccttcaggagttcttttagggcaggcctggtggtgacaaaatctcagcatttgcttgtctgtaaagtattttatttctccttcacttatgaagcttattttggctggatatgaacttctgggttgaaaattcttttctttaa

SEQ ID NO: 12545 - DNA, 6176 bp, Homo sapiens
ttttattttatttttttattttattattattatactttaagttttagggtaatgtgcacaatgtgcaggtttgttacatgtctatacctgtgccatgttggtgtgctgcacccattaactcgtcatttagcattaggtatatctcctaatgctatccctcccccctcccccctccccacaccccacaacagtccctggagtgtgatgttccccttcctgcgtccatgtgttctcattgttcaattcccacctgtgagtgagaacatgcggtgtttggttttttctccttgcgatagtttgctgagaatgatggtttccaatttcatccatgtccctacaaaggacatgaactcttcattttttatggctgcatagtattccatggtgtatatgtgccacatttgcttaatccagtctatcattgctggacatttgggttggttccaagtctttgctattgtgaatagtgccccaataaacatacgtgtgcatgtgtctttatagcagcatgatttataatcctttgggtatatacccagtaatgggatggctgggtcaaatggtatttctagttctagatccctgagtaatggccacactgacttccacaatggttgaactagtttacagtcccaccaacagtgtaaaagtgttcctatttgtccacatcctctccagcacctggtggtttcctgactttttaatgattgccattctaactgatgtgagatggtatctcattgtggtattgatgtgcatttctctgatggccagtgatgatgagcattttttcatgtgttttttggctgcataaatgtcttcttttgagaagtgtctgttcatatcctttgcccacttattgatggggttgtttgtttttttcttgtaaatttgtttgagttcattgtagattctggatattagccctttgtcagatgagtaggttgcgaaaattttctcccattctgtagcttgcgtgttaatgctgatggtagtttcttttgctgtgcagaagctctttagtttaattagatcccatttgtcaatattgtcttttgttgccactgcttttggtgttttagacatgaagtccttgcccatgcctatgtcctgaatggtattgcctaggttttcttctagggtttttatggttttaggtctaacatgtacgtctttaatccatcttgaattaatttttgtataaggtgtaaggaagggatccagtttcagctttctacatatggctagccagttttcctagcaccatttattaaatagggaatcctttccccattgcttgtttttctcaggtttgtcaaagatcaaatggttgtagatatgtggcattatttctgagggctctgttctgttccattgatctatatctctgttttggtactagtaccatgctgttttggttactgtagccttgcagtatagtttgaagtcaggtagcctgatgcctccagctttgttcttttggcttaggattgacttggcgatgcaggctcttttttggttccatatgaaatttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttctggttctccttgaagaggtccttcacatcccttataagttggattcctagatattttattctctttgtagcaattgtgaatgggagttcactcatgatttggctctctgtttgtctgttattggtgtataagaatgcttgtgatttttgtacattgattttgtatcctgagactttgctgaagttgcttatcagcttaaggagattttaggctgagacaatggggttttctagatatacaatcatgtcatctgcaaacagggacaatttgacttcctcttttcctaattgaatgccctttatttccttctcctgcctaattgccctggccagaacttccaatactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaagttattgagagtttttagcatgaagggttgttgaattttgtcaaaggccttttctgcatctattgagataatcatgtggtttttgtctttggttctgtttatatgctggactacatttattgatttgcgtatattgaaccagccttgcatcccagggatgaagcccacttgatcatggtggataagctttttgatgtgctgctggattcggtttgccagtattttattggggatttttgcatcaatgttcatcaaggatattggtctaaaattctcttttttggttttgtctctgccaggctttggtatcgggatgatgctggcctcataaaatgagttagggaggattccctctttttctattgattggactagtttcagaaggaatggtaccagctcctttttgtacctctggtagaattcggctgtgaatccatctggtcctggactttttttggctggtaagctattgattattgccataatttcagagcctgttataggtccattcagagattcaacttcttcctggtttagtcttgggagggtgtatgtgtccaggaatttatccatttcttctagattttctagtttatttgcgtagaggtgtttgtagtattctctgatggtagtttgtgtttctgtgggatcggtggtgatatccccattatcattttttattgcgtctatttgattcttctctcttttcttctttattagtcttgctagcagtctatcgattttcttgatcttttcaaaaaaccagctcctggattcattaattttttgaagggctttttgtgtctctatctccttcagttctgctctgattttagttatttcttgccttctgctagcttttgaatgtgtttgttcttgcttttctagttcttttaattgtgacgttagggtgtcaattttggatctttcctgcttcctcttgtgggcatttagtgctataaatttccctctacacactgctttgaatgtgtcccagagattctggtatgttgtgtctttgttctggttggtttcaaagaacatctttatttctgccttcatttcattatgtacccagtagtcactcaggagcaggttgttcagtttccatgttgttgagcggttttgagtgagtttcttagtcctgagttctagtttgattgcactgtggtctgagagacagtttgttataatttctgttcttttacatttgctcaggagtgctttacttccaactgtgtggtcaattttggaataggtgtggtgtggtgctgaaaaaaatgtatattctgttgatttggggtggagagttctgtagatgtctattaggtccgcttggtgcagaggtgagttcaattcccgggtatccttgttaactttctgtctcgttgatctgtctaatgttgacagtggggtgttaaaatctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacattcaaagttaatattgttatgtgtgtatttggtcctgtctttatgatgttagctggttattttgctcgttagttgatgcagtttcttcctagccttgatggtctttacattttggcatgtttttgcagtggctggtaccggttgttcctttccatgtttagtgctcccttcaggagctcttttagggcaggcctggtggtgacaaaatctctcagcgtttgcttgtctgtaaagtattttatttctccttcacttatgaagcttagtttggctggatatgaaattctgggttgaaaattcttttctttaagaatgttgaatattggccctcactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttgttgaggagtatctttgtggcgttctctgtatttcctgaatctgaatgttggcctgccttgctagattggggaagttctcctggataatatcctgcagagtgttttccagcttgtttccattctccccatcgttttcaggtacaccaatcagacgtagatttggtctttccacatagtcccatatttcttggaggctttgttcatttctttttattctttttttctctaaacttcccttctgacttcatttcattcattttgtcttccatcactgataccctttcttccagttgatcacatcagctcctgaggcttctgcattcttcacgtagttctcgagccttgacttttggctccatcagctcctttaaggacttctctgcgttagttattttagttatccattcgtctaattttttttcaaagtttaaaacttctttgccattggtttgaatttcctcctgtagctcggagtactttgattgtctgaagccttcttctctcagctcctcaaagtcattttccgtccagctttgttctgttgctggtgaggagctacgttcctttggaggaggagaggcgttctgctttttagagtttccagtttttctgctctgctttttccccatctttgtggttttatctacttttggtctttgatgatggtgacgtacagaagggtttttggtgtggatgtcctttctctttgttagttttccttctaacagacaggacccttagctgcaggtctgttggagtttgctagaggtccactccagaccctgtttgcctgggtatcagcagcggtgtctgtagaacagtggatcttggtgaaccacaaatgctgctgcctgatcgttcctctggaagttttgtctcagaggagtacccagccgtgcgaggtgtcagtctgcccctactgggggatgcctcccagttaggctgcttaggtgtcaaggatccacttgaggaggcagtctgcccattctcagatctccagctgcgtgctgggagaaccactgctctcttcaaggctgtgagacagggacatttaagtctgcagaggttactgctgtctttttgtttgtctgtgccctgcccctagaggtggagcctacagaggcaggcaggcctccttgagctgtggtgggctccactcagttcgagcttcccagctgctttgtttacctaatcaagcctgggcaatggcaggcgcccctcctccagcctcgctgccaccttgcagtgtgatctcagactgctgtgctagcaatcagcgagattccgcgagcataggaccctccgagccaggtgcgggatataatctcctggcatgctgtttttttaagcccgttggaaaagcacagtattagggtgggagtgacccgattttccaggtgccatctgtcacccctttctttgactaggaaagggaactccctgacgccttgtgcttcccgagtgaggcaatgcctcgccctgcttcggctcgcgcacgttgcgctgcacccactgtcctgcacccactgtctggcactccctagtgagataaacccggtacctcagatggaaatgcagaaatcacctgtcttctgtgactctcacgctgggagctgtagaccagagctgttcctattcggccatcttggctccacc

SEQ ID NO: 12546 - DNA, 6082 bp, Homo sapiens
ttttttttgtctttttcttttttttttaatgggttttcttttttatttatttatttatttattttttatactttaagttttagggtacatgtgcacaatgtgcaggttagttacatatgtatatatgtgccatgctggtgcgctgcacccactaactcgtcatctagcattaggtatatctcccaatgctatccctcccccctccccccaccccaccacaggccccagagtgtgtgatattctccttcctgtgtccatgtgacctcattgttcaattctcacctatgagtgagaatatgcggtgtttggttttttgttcttgcgatagtttactgagaatgatgatttccaatttcatccatgtccctacaaaggacatgaactcatcattttttatggctgcatagtattccatggtgtatacgtgccacattttcttaatccagtctatcattggtggacatttgggttggttccaagtctttgctattgtgaataatgccgcaataaacatacgtgtgcatgtgtctttatagcagcatgatttatagtcctttgggtatacacccagtaatgggatggctgggtcaaatggtatttctagttctagatccctgaggaatctccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtttggctgcataaatgtcttcttttgagaagtgtctgttcatgtccttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtgaattttgtcttttgttgccattgcttttggtgttttggacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttcccaattgcttgtttttctcaggtatttcaaagatcagatagttgtagatatgcggcattatttctgagggctctgttctgttccattgatctatatctctgttttggtaccagtaccatgctgttttggttaccgtagccttgtagtatagtttgaagtcacgtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcgtggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagagaatgcttccagtttttgcccattcagtatgatattggctgtgggtttgtcatagacagttcttattattttgaaatacgtcccatcaatacctaatttattgagagtttttagcatgaagtgctgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttctggttgtgtctctgcccggctttggtatcagaatgatgctggcctcataaaatgagttagggaggattccctcattttctattgattggaatagtttcagaaggaatggtaccagttcctccttgtacctctggtagaattcggctgtgaatccatctggtcctggactctttttggttggtaaactattgattattgccacaatttcagctcctattattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcatttttttattgtgtctatttgattcttctctctttttttctttattagtcttgctagtggtctatcaattttgttgatcctttcaaaaaacagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacgtcccagagattctggtatgttgtgtctttgttctcgttggtttcaaagaacatctttatttctgctttcattgcgttatgtaaccagtagtcattcaggagcaggttgttcagtttccatgtagttgagcagttttgagtgagattcttaatcctgagttctagtttgattgcactgtggtctgagagatagtttgttataatctctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctaggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattcagtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcatatgtgtgtctctgtacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttggttgatgcagtttcttcctagtctcgatggtctttacattttggcatgattttgcagcggctggtaacggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtatgatgggcttccttttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattagggaagttctcctggataatatcctgcagagtgttttccaacttgtttccattctccccatcactttcaggtacaccaatcagacgtagatttggtcttttcacatagtcccatatttcttggaggctttgctcatttctttttattcttttttctctaaacttcctttctcgcttcatttcattcatttcatcttccatcgctgataccctttcttccagttgatcacatcggctcctgtggcttctgcattcttcacgtagttctcgagccttggttttcagctccatcagttcctttaagcacttctctgtattggttattctagttatacattcttctaaatttttttcaaagttttcaacttctttgcctttggtttgaatgtcctcccatagttcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggagtgcctcccagttaggctgctcgggggtcaggggtcagggacccacttgaggaggcagtctgcccgttctcagatctccagctgcgtgctgggagaaccactgctctcttccaagctgtcagacagtgacatttaagtctgcagaggttactgctgtctttttgtttgtctgtgcccttcccccagaggtggagcctacagaggcaggcaggcctccttgagctgtggtgggctccacccagttggagcttccgggctgctttgtttacctaagcaagcctgggcaatggcgggcgcccctcccccagcctcgctgccgccttgcagtttgatctcagactgctgtgctagcaatcagcgagactccatgggtgtaggaccctccgagccaggtgcgggatataatctcgtggtgcgccgttttttaagcaggtccaaaaagcgcaatattcgggtgggagtgacctgattttccaggtgcgtccgtcacccctttctttgactcagaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgctcacgctgggagctgtgtaccggagctgttcctattcggccatcttggctcctccccca

SEQ ID NO: 12547 - DNA, 6062 bp, Homo sapiens
tttcttttttttttaattttattttattattattttttcttttattattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccacaacagtccccagagtgtgatgttccccttcctgtgtccatgtgatctcattgttcaattcccacctatgagtgagaatatgcattgtttggttttttgttcttgcgatagtttactgagaatgatgatttccaatttaatccatgtccctacaaaggacatgaactcatcattttttagggctgcatagtattccatggtgtatatgtgccacattttctgaatccagtctatcattgttggacatttgggttggttccaagtctttgctattgtgaatagtgccgcaataaacatacgtgtgcatgtgtctttatagcagcatgatttctagtcctttgggtatatacccagtaatgggatggctgggtcaaatggtaattctagttctagatccctgaggaatcgccacactgacttccacaatggttgaactagtttacagtcccaccaacagtgtaaaagtgttcctatttctacacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattcttgatattagccctttgtcagatgagtaggttgcgaaaattttctcccattttgtaggttgcctgttcactctgatggtagtttcttttgctgtacagaagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccgtgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttacatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggatttttgtacattgattttgtatcctgagactttgctgaagttgcttatcagcttaaggagattttgtgctgagacaatggggttttctagatatacaatcatgtcgtctgcaaagagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagaaaatcatgtggtttttgtctttggctctgtctatatgctggattacatttattgatttgcatatattgaaccagccttgcatcccagggatgaagcccacttgatcatggtggataagctttttgatgtgctgctggattcgtttggccagtattttattgaggatttttgcatcaatgttcatcaaggatgttggtctaaaattctcttttttggttgtgtccctgccaggctttggtatcagaatgatgctggcctcataaaatgagttagggaggattccctctttttctattgattggaatagtttcagaaggaatggtaccagttcctccttgtacctctgatagaattcagctgtgaatccatctggtcctggactctttttggttggtaagctattgattattgccacaatttcagatcctgttattggtctattcagagattcaacttcttcctggtttagtcttgggagagtgtatgtgtcgatgaatttatccatttcttctagattttctagtttatttgggtagaggtgtttgtagtattctctgattgtagtttgtatttctgtgggatcggtggtgatatcccctttatcattttttattgcatctatttgattcttctccctttttttctttattagtcttgctagcagtctatcaattttgttgatcctttcaaaaaaacagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctctggtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgcagaaaaaaatgtatattctgtggatttggggtggagagttctgtagatgtctattaggtccgcttggtgcagaggtgagttcaattcctgggtatccttgttgactttctgtctcgttgatctgtctaatgttgacagtgtggtgttaaagtctcccattattaatgtgtgggagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtatctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagcagctgacaccggttgtccctttccatgtttagcacttccttcaggagctcttttagggcaggcctggtggtgacaaaatctctcagcatttgcttgtctgtaaagtattttatttctccttcacttatgaagcttagtttggctggatgtgaaattctgggttgaaaattctttcctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgataattatgtgtcttggagttgctcttctcgaggagtatctttgtggtgttctctgtatttcctgaatctgaacgttggcctgccttgttagattggggaagttctccgggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcatgtagttctcgagccttggttttcagctccatcagctcctttaagcacttctctgtattggttattctagttatacattcttctcaatttttttcaaagttttcaacttctttgcctttggtttgaatgtcctcccatagctcagagtaatttgatcgtctgaagccttcttctctcagcttgtcaaagtcgttctccgtccagctttgttctgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcaggtgcaggtctgttggagtaccctgccgtgcgaggtgtcagtgtgcccctgctgtggggtgcctcccagttaggctgctcgggggtcaggggtcaggtacccacttgaggaggcagtctgcccgttctcagatctccagctgcgtactgggacaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggctgctgccttgcagtctgatctcagactgctgtgctagcaatcagtgagactctgtgggcgtaggaccctccctgccaggtgtgggatataaactcgcgctgcgccgttttttaagcccgtcggaaaagcgcagtattcgggtgggagtgacccgattttccaggtgagtccgtcacccctttctttgactcggaaagggaactccctgaccccttgcgcttccggagtgaggcaatgcctcgccctgcttcggctcgcgcacggtgggcgcacccactgacctgtgcccactgtctggcactccctactgagatgaacctggtacctcagatggaaatgcagaaatcacccgtcttctgcgtcgctcacgctgggagctgtagaccggagctgttcctattcggccatcttggctcctccc

SEQ ID NO: 12548 - DNA, 5807 bp, Homo sapiens
tttaccatctttttattattattattaaagttctagggtacatgtgcacaacgtgcaggtttgttacatatgtatacatgtaccatgttggtgtgctgcacccattaactcgtcatttagcatttggtatatcacctaatgctatccctcccccctcccccctccccccaccccacagcagtgcccggtgtgtgatgttccccccttcctgtgtccatgtgttctcattgttcagttcccacctatgagtgaaaacgtggtgtttggttttttgtccatgcgatagtttgctgagaatgatggtttccagcttcatccatgtccctacaaaggacatgaactcatcattttttatggctgcatagtattccatggtgtatatgtgccccattttcttaatccagtctatcattgttggacatttgggttggctccaagtctttgctattgtgaatagtgccacagtaaacatatgtgtgcatgtgtctttatagcagcatgatttataatcctttgggtatatacccagtaatgggatggctgggtcaaatggtatttctagttctagatccctgagaaatcgccacaccgacttccacaatggttgaactagtttacagtcccaccaacagtgttaagtgttcctatttttccacatcctctccagcacctgttgtttcctgactttttaatgatcgccattctaactggtgtgagatggtatctcattgtggttttgatttgcaattctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttctttgtagattctggatattagccctttgtcagatgagtaggttgcaaaaattttctcccattctgtaggttgcctgttcactctgatggtggcttcttttgctgtgcagaagctctttagtttaattagatcccattggtcaattttggcttttgttgccattgcttttggtgttttagacatgaagtccttgcccatgcctatgtcctgaatggtattgcctaggttttcttctagggtttttatggttttaggtctaacacgtaagtctttaatccatcctgaattaattttttgtataaggtgtaaggaagggatccagtttcagctttctacatatggctagtcagttttcccagcaccatttattaaataggcaatcctttccccatttcttgtttttgtcaggtttatcaaagatcagatagttgtagatatgaggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctgtgaagaaagtcattggtagcttgatggggatggcattgaatctataaattaccttgggcagtaaggccattttcatgatattgattcttcctacccatgagcatggaatgttcttccatttgtttgtatcctcttttatttcattgagcagtggtttgtagttctccttgaagaggtccttcacatcccttgtaagttggattcctagctattttattctctttgaagcaattgtgactgggagttcactcatgatttggctctctgtttgttattggtgtataagaatgcttgtgatttttgcacattgattttgtatcctgagactttgctgaagttgcctatcagcttaaggagattttgggctgagacgatggggttttctagatatacaatcacatcatctgcaaacagggacaatttgacttcctcttttcctaactgaatgccctttatttccttctcctgcctgattgccctggcccgaacttctgacactgtgttgagtaggagtggtgagagagggcatcctgtcttgtgccagttttcaaagggaatgcttccagtttttgtccattcggtatgatattggctgtaggtttgtcatagatagctcttattattttgagatacgtcccatcaatacctaacttattgagagtttttagcatgaagggttgttgaattttgtcaaaggccttttctgcatctattgagataatcatgtggtttttgtctttggttctgtttatgtgctggattacgtttattgattacgtttattgcatcccagggatgaagcccacttgatcatggtggataagctttttgatgtgttgctggattcgatttgccagtattttattgaggatttttgcatcaatattcatcagggatattggtctaaaattctctttttttgttgtgtctctgccaggctttggtatcaggatgatgctggcctcataaaatgcgttagggaggattccctctttttctattgattggaatagtttcagaaggaatggtaccagctcctccttgtacctctggtagaattcggctgtgcatccatctggtcctggactttttttggttggtaagctattaattattgcctcaatttcagagcctgttattggtctattcagagattcaacttcttccttgtttagtcttgggagagtgtatgtgttgaggaatttatccatttcttctagattttctagtttatttgcgtagaggtgtttatagtattctctaatggtagtttgtatttctgtgagatcggtggtgatatcccctttgtcattttttattgcgtctatttgattcttctctcttttcttctttgttagtcttgctagcggtctaacaattttgttgatcttttcaaaaaaccagctcctggattcattaattttttgaagggtctttttgtgtctctatttccttcagttctgctctgatcttcgttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttggtctcattggtttcaaagaacatctttatttctgccttcatttcgttatgtacccagtagtcattcaggagcaggttattcagtttccatgtagttgagcggttttgagtgagtttcttaatcctgagttctagtttgactgcaccatggtctgagagacagtttgttataatttctgttcttttacatttgctgagaagtgctttacttccaactatgtggtcaattttggaataggtgtggtgtggtgctgaaaagaatgtatattctgttgatttggggtggagagttctgtagatgtctattaggtctgcttggtgcagagctgagttcaattcctggatatccttgttaagtttctgtctcattgatctgtctaatgttgacagtggggtgttaaagtctcccattattattgtttgggagtctaagtctctttgtaggtcactaaggacttgctttatgaatctggatgctcctgtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttgcttggtagatcttcttccatccatttgttttgagcctatgtgtgtctctgcatgtaagatgggtttcctgaatacagcacactgatgggtcttgactctttacccaatttgccagtctgtgccttttaattggagcatttagcccatttacatttaaggttagtattgttatgtgtgaatttgatcctgtcattatgatgttagctggttattttgcttgttagttgatgcagtttcttcctagccttgatggtctttacaatttggcatgtttttgcagtggctggtaccggttgttcctttccatgtttagtgctcccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatcagctgttagtctgatgggcttccctttgtgggtaacccgacctttctctctggctgcccttaacattattcccttcatttcaactttggtgaatctgacaattatgtgtcttggagttgctcttcttgaggagtatctttgtggcattctctgtatttcctgaatttgaatgttggcctgccctgctagattggggaagttctcctggataatatcctgaagagtgttttccaacttgtttccattctccccgtcactttcaggtacaccaattagatgtagattttgtcttttcacatagtcccatatttcttggaggctttgttcgtttctttttattcttttttctctaaacttctcttcatacttcatttcattcattttgtcttccatcgctgataccctttcttccagttgatcgcatcggctactgaggcttgtggattcgtcacagagttctcgtgccatggttttcagctccatcaggtcctttaaggacttctctgcattggttattctagttatccattcgtcttaattttttttcaaagtttttaacttctttgccattggttctaacttcctcctttaattcagagtagtttgatcttctgaagccttcctctctcaactcgtgaaatcattctccatccagctttgttctgttgctggtgaggagctgcgttcctttggaggaggagaggcactctgatttttagagtttccggtttttctgctctgttttttgcccatctttgtggttttatctacctttggtctttgatgatggtgacgtacagatgggtttttggtgtggatgtcctttctgtttgttagttttccttctaacaatcaggaccctcagctgcaggtctgttggagtttactggaggtccactccagaccctgtttgcctgggtatcagcagtggtggctgcagaacagcggatattggtgaactgcaaatgctgctgcctgatcgttcttctggaatttttgtctcagaggagtacccggccgtgtgaggtgtcagtccgcccctacttgggggtgcctcctagttaggctactcgggagtcagggacccacttgaggaggcggactgcctgttctcagatctcaagctgcatgctgggagaaccactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttcgagcttcccagccactttgtttaactattcaaggctgagcaatggcgggcgcccctcccccagccttgctgccgccttgcagtttgatctcagactgctgtgctagcaatgagcaaggctccatgggcgtaggaccctctcagccaggtgc

SEQ ID NO: 12549 - DNA, 5870 bp, Homo sapiens
tttgtttattctttattttgtagacgtaatttttttttcatttattttctttcttttttttattattattatgctttaagttttagggtacatgtgcacaatgtgcaggttagttacatatgtatacatgtgccatgctggtgtgctgcatccattaactcgtcatttagcattaggtatatctcctaatgctatccctccccactccccccaccccacaacagtccccagagtgtgatgttccccttcctgtgtccatgtgttctcattgttcaattcccatctatgagtgagaacatgaagtgtttggttttttgtccttgcgatagtttgctgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctattgtaaatagtgccacaataaacatacatgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcttctccagcacctgttgtttcctgactttttaatgattgccattctaactggtaagagatggtatctcattgtggttttgatttgcatttctctgatggccagtgatggtgaacatttttccatgtgtcttttggctgcataaatgtcttcttttgagaagtgtctgttcatatcctttgaccactttttgatggggttgtttgtttttttcttgtaaatttgtttgagttcattgtagattctggatattagccctttgtcagataactaggttgtgaaaattttctcccattttgtaggttgcctgttaactctgatggtagtttattttgctgtgcagaagctctttagtttaattagatcccatttgtcaattttggcttttgttgccattgcttttgctgttttagatatgaagtccttgcctatgcttatgtcctgaatggtaatgcctaggttttcttctatggtttttatgtttttaggtctaacatttaagtctttaatccatctttaattaatttttgtataagctgtaaagaagggatccagtttcagctttatacatatggctagctagtttgcccagcaccatttattgaacagggaatcctttccccattgcttgtttttctcaggtttgtcaaagatcagatggttgtagatatgtggcattatttctgagggctctgttctgctccattgatctatatctctgttttgataccagtaccatgctgttttggttactgtagccttgtagtatagtttgaagtcaggtaatgtgatgcctccagctttgcacttttggcttaggattgattttgtgatgcagggtcttttttggttccatatgaactttaaagtagttttttccaattctgtgaagaaaatcattggtagcttgatggggatggcattgaatctataaattactgtgggcaatatggccattttcacgatattgattcttcctacccatgagcatgtaatattcttccatttgtttgtatcctcttttatttcattgaggtttgtagttctccttgaagaggtccttcacgtcccttgtaagttggattcctagatattttactctttttgaagcaattgtgaatggaattcactcatgatttggctctctgtttgtctgttattagtgtataagaatgcttgtgatttttgtacattgattttgtatcctgagactttgctgaagttgcttatcagcttaaggagattttgggctgagacaatggggttttctagatatacaatcatgtcgtctgaaaacagggataatttgactttctcttttcctaattgaatacccttgatttccttctcctgcctgattgccctggccagaacttccaacactatgttgaataggagtggtgagagagtgcatccatgtcttgtgccagttttcaaagggaatgcttccagtttttgcccattcagtatgatattggctgtgggtttgtcatagatagctcttagtattttgagatacgtcccatcagtacctaatttattgagagtttttagcatgaagagttgttgaattttgtcaaaggccttttctgcatctgttgagataatcatgtggtttttgtctttgattctgtttatatgctggattacatttattgatttgcttatattgaacgagccttgcatcccagggatgaagcccacttgatcatggtggataaggttttggatgtgctgctagattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctgatagaattcggctgtgaatccatctggtcctggactcttttttgttggtaagctattgattattgccacaatttcagatcctgttattggtctcttcagagattcagcttcttcctggtttagtcttgggagagtgtatgtgtcgaggaatttatccatttcttctagattttctagtttatttgcatagaggtgtttgtagtattctctgatggtagtttgtatttctgtgggattggtggtgatatcccctttatcattttttattgtgtctattttactgttctctctttttttctttattagtcttgctagcggtctatcagttttgttgatcctttcaaaaaaccagctcctggattcattaactttttgaagggttttttgtgtctctatttcctgcagttctgctctgattttagttatttcttgccttctgctagcttttgaatgtttgcacttgcttttctagttctttttattgtgatgttagggtgtcaattttggatgttttctgctttctcttgtgggcatttagtgctataaatttctctctacacactgctttgaatgtgtgccagagattctggtatgttgtgtctttgttctccttggtttcaaagaacacctttatttctgccttcatttcgttatgtacccagtagtcattcaggagcaggttgttcagtttccatgtagttgagctgttttgagtgagtttcttaatcttgagttctagtttgatttcactgtggtctgagagacagtttgttatgaatttctggtcttttacatttgttgaagagagctttacttccaactatgtgtgttcaattttggaataggtgtggtgtggtgtagtactgaaaaaaatgtatattctgttgatttggggtggagagttctgtagatgtctattaggtccgcttggtgcagagctgagttcgattcctgggcatccttgttaactttctttctgattgatctgtctaatgttgacagtggggtgttaaagtctcccattattattgtgtgggagtctaagtctctttgtaggtcactcaggacttgctttataaatctgggtgctcctgtattgggtgcatatatatttaggatagttagctcttcttgttgaattgatacctttaccattctgtaatggccttctttgtctcttttgatctttgttggtttaaagtctgttttatcagagactaggattgcaacctctgcctttttttgttttcaatctgcttggtagatcttcctccatccttttatttggagcctatgtgtttctctgcatgggagatgggtttcctgaatacagcacactgatggatgttgactctttaaccaatttgccagtctgtgtcttttaattggagcatttagtccatttatatttaaagttaatattgttatgtgtgaatttgatcctatcattatgatgttagctggttattttactcattagttgatgcagtttcttcctagtctcgatggcctttacattttggcttgattttgtagtggctggtaccggttcctttccatgtttagtgcttctttcaggagctcttttagggcaggcctggtggtgacaaaatctctcagcatttgcttgtctgtaaagtattttatttctcctttacttatgaagcttagtttgcctggatatgaaattctgggatgacaattcttttctttaggaatgtcgaatattggcccccactctcttctggcttgtagagtttctgctgagagatccgctgttggtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgagtgttggcctgccttgctagattggggaagttctcctggataatgccctgcagagtgttttccacctcggttccattctccctgtcactttcaggtacaccaagcagacatagatttggtcttttcacatagtcccatatttcttggaggctttgttcatttctttttattcttttttctctaaacttcccttcttgcttcatttcattcatttcatcttccatcactgataccctttcttccagttgattgcatcagctcctgaggcttctgcattcttcacgtagttctcgagtcttggctttcagctccatcagctcctttaagcacttctctctattgattattctagttatacattcatctagatttttttcaaaattttcaacttctttgcctttggtttgaatttcctcctgtggattgtagtagattgatcgtctgaagccttcttctctcaacttatcaaagtcattctccatccagctttgttccgttgctggtgaggaactgtgttcctttggaggaggagaggcactctgctttttagagcttccagtttttctgctctgttttttccccatctttgtggttttatcttcttttggtctttgatgctggtgatgtgcagatgggtttttggtgtggatgtcctttctgtttgttagttttccttctaacagacaggaccctcagctgcaggtctgtttgagtttgctagaggtccactccagaccctgtttgcctgggtatcagcagcggtgtctgcagaacagagaattttcatgaaccgtgaatgctgttgtctgatcgtttctccggaagttttgtcccagaggagtacccggctgtgtgaggtgtcagtctgtccctattagggggtgccttccagttaggctgctcgggggtcaggggtcagggacccacttgaggaggcagtctgcccattctcagatctccagccgcgtgctgggagaaccactgctttcttcaaagctgtcaggcaggtacatttaagtctgcagaggttactgctgtctttttgtttgtctgtgccctgcccccagaggtggaacctacagaggcaggcaggcctccttgagctgtggtgggctccacccagttcgagtttcccagctgctttgtttacctaagcaagcccgggcaatggcgggcccccctcccccagccgcactgctgccatgcagtttgagctcagactgctgtgctagcatcagcaagactctgtgggcgtaggaccctctgagccaggtgtg

SEQ ID NO: 12550 - DNA, 5729 bp, Homo sapiens
ttcttttttatttatttatttatttatttatttatttatttatttatttatttttatcattatactttaagttttagggtacatgtgcacattgtgcaggttagttacatatgcatacatgtgccatgctggtgcgctgcacccactaactcgtcatctagcattaggtatatctcccaatgctatccctccccgctgcccccacccctccaccgttcccagactgtgatattccccttcctgtgtccatgtgatctcattgttcaattcccacctatgagtgagaatatgcggtgtttggttttttgttcttgcgatagtttactgagaatgatgctttccaatttcatccatgtccctacaaaggacatgaactcatcattttttatgcttgcatagtattccatggtgtatatgtgtcacattttcttaatccagtctatcattgttggacatttgggttggttccaagtctttgctatcgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaaccagtttacagtcccaccaacagtgtaaaagtgttcctatttctccacatcctctccagcacctgttgtttcctgactttttcatgattgccattctaactggtgtgagatgctatctcattgtggttttgatttgcatttctctgatggccagtgatgagcgttttttcatgtgttttttggctgcataaatgtcttcttttgagaagtgtctgttcatgtccttcgcccactttttgatggggttgtttgattttttcttgtaaatttgtttgagttcattgtagattctggatattaaccctttgtcagatgagtaagttgcgaaaattttctcccattttgtaggttgcctgttcactctgatggtagtttcttttgctgtgcagaagctctttagtttaattagatcccatttgtcaattttgtcttttgttgccattgcttttggtgttttggacatgatgtccttgcccgtgcctatgtcctgaatggtaatgcctaggttttcttctagggtttttatggttttaggtctaacgtttaagtctttaatccaccttgaacatcttgaattgatttttgtataaggtgtaaggaagggatccagtttcagctttctacatatggctagccagttttcccagcaccatttattagatagggaatcctttccccattgcttgtttttgtcaggtttgtcaaagatcagatagttgtagatatgcagcgttatttctgagtgccctgttctgttccattgatctatatctctgttttggtaccagtaccatgctgttttggttactgtagccttttagtatagtttgaagtcaggtagtgtgatgcctccagctttgttcttttgcttaagattgacttggcgatgcaggctcttttttggttccatatgaactttaaagtagttttttccaattctgtgaagcaagtcattggtaccttgatggggatggcattgaatctataaattaccttgggcagtatggccattttcatgatattcattcttcctaaccatgagcatggaatgttcttccatttgtttgtatcctcttttatttccttgagcagtggtttgtagttctcattgaagaggtccttcacatccctggtaagttggattcctatgtattttattctctttgaagcaattgtgaatgggagttcactcatgatttggctctctgtctgtctgttggtggtgtataagaatgcttgtgattttttacattgattttgtatcctgagactttgctgaagttgcttatcagcttaaggagatgttggactgagacaatggggttttctaggtatacaatcatgtcatctgcaaacagggaaaatttgacttcctcttttcctaattgaataccctttatttccttctcctgcctaattgccctggccagaacttccaacactatgttgaataggagtggtgagaaagggcatccctgtcttgtgccagttttcaaagggaatgcttccagtttttgcccattcagtatattggctgtgggtttgtcatagatagtgcttattattttgaaatacgtcccatcaatacctaatttattgagagtttttagcatgaagggttgttgaattttgtcaaaggctttttctgcatctattgagataatcaggtggtttttgtctttggctctgtttatatgctggattacatttattgatctgcatatattgaaccagccttgcatcccaggaatgaagcccacttgatcatggtggataagatttttgatgtgctgctggattcgttttgccatattttattgaggatttttgcatcaatgttcatcaaggatattggtctaaaattctcttttttggttttgtctctgcccggctttggtatcagaatgatgctggcctcataaaatgagttacggaggattccctctttttcattgattggaatagtttcagaaggaatggtaccagttcctccttgtacctctggtagaattcggctgtgaatccatctggtcctggactctttttggttggtaaagtattgattattgccacaatttcagctcctgttattggtctattcagacattcaacttcttcctggtttagtcttgggagagtgtaagtgtcgaggaatttatccatttcttctagattttctagtttatttgcgtagaggtgtttatagtattctctgatggtagtttgtatttctgtgggatcggtggtgatatcccctttataattttttattgtgtctatttgattcttctctctttttttctttattagtcttgctagcggtctatcaattttgttgatcccttcaaaaaaccagctactggattcattaattttttgacgggttttttgtgtctctatttccttcagttctgctctgattttagttatttcttgccttctgctagcttttgaatgtgtttgctcttgcttttctagttcttttaattgtgatgttagggtgtcaattttggatctttcttgctttctcttgtgggcattcagtgctataaatttccctctacacactgctttgaatgcgtcccagagattctggtatattgtgtctttgttctcattggtttcaaagaacatctttatttctgccttcatttcattatgtacccagtagtcattcaggagcagcttgttcagtttccatgtagttgatcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgaatttctgtctcattgatctgtctgatgttgacattgggtgttaaagtctcccattattaatgtgtgggagtctaagtctctttgtaggtcactcaggacttgctttatgaatctgggtgctcctgtattgggtgcatatatatttaggatagttaactcttcttgttgaattgatccctttaccattatgtaatggccttctttgtctcttttgatctttgttcatttaaagtctgttttatcagagactaggattgcaacctctgcctttttttgttttccatttgcttggtagatcttcctccatccttttattttgagcctatgtgtgtctctgcttgtgagatgggtttcctgaatacagcacactgatggatcttgactctttatccaatttgccagtctgtatcttttaattggagcatttagtccatttacatttaaagttaatattgttatgtgtgaatttgatcctgtcattatgatgttagctggtgattttgctcgttagttgatgcagtttcttcctagtctcgatggtctttatatttgggcatgattttgcagcggctggtactggttctgcctttccatgtttagcgcttccttcgggagctcttttagggcaggcctggtggtgacaaaatctctcagcatttgcttgtctgtaaagtattttatttctccttcacttatgaagcttagtttggctggatatgaaattctgggttgaaaattctttctttaagaatgttgaatattggcccccactctcttctggcttgtaaggtttctgctgagagatctgctgttagtctgatgggcttccctttgagggtaacctgacctttctctctggctgcccttaacattttttccttcatttcaactttggtgaatctgacaattatgtgtcttggagttgctcttctcaaggagtgtctttgtggtgttctctgtatttcctgaatctgaacgttggcctgccttgctagattggggaagttctcctggataatatcctgcagagtgttttccaacttggttccattctccccatcactttcaggtacaccaatcagatgtagatttgatcttttcacatagttccatatttcttggaggctttgctcatttctttttattcttttttctctaaacttcccttctcacttcatttcattcatttcatcttccattgctgataccctttcttccagttgatcgcatcagctcctgaggcttctgcattcttcacgtagttctggagccttggttttcagcttcatccgctcctttaagcacttctctgtattggttattccagttatacattcttctaaatttttttcaaagttttcaacttctttgcctttggtttgaatgtcctcccatagctcagagtaatttgattgtctgaagccttcttctctcagctcgtcaaagtcattctccatccagctttattctgttgctggtgaggaactgtgttcctttggaggaggagaggcactctgcgttttagagtttccagtttttctgttctgctttttcccaatctttgtggttttatctactttggtctttgatgatagtgatgtacagatgtgtttttggtgtggatgtccttcctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaagctgtcagacagggacgtttaagtctgcagaggttactgctgtctttttgtttgtctgtgccctgcccccagaggtggagcctacagaggcaggcaggccttcttgagctgtggtggactccacccagttggagcttcctggatgctttgtttacctaagcaagcctggacaatggtgggcgtccctcccccagcctcgctgccaacttgccgtttgatctcaaactgctgtgctagcaatcagtgagacttcatgggcataggaccctcccagccagg

SEQ ID NO: 12551 - DNA, 5000 bp, Homo sapiens
tatatctcaattatctggaatacatagagtccatttccattttgttgattttcttggtgttttcttattttctagtatgcatcactattttaattttaatgccagacattgtttatgaaaaatggtgaagtaatttgaggcctataatgattttatattcttttgttttattatactttaagttctagggtacaggtgcacaacatgcaggtttgatacataggtatatgtaggccatgttggtttgctgcacccatcaactcgtcatttacattagctttttctcctaatgctattcctcccccacccctccaaccctaacaggccccggtgtgtgatgttccccgccctgtgtccaagtgatctcattgttcaattcccacctatgagtgagaacatgcagtgtttggttttctgtccttgtgatagtttgctgagaatgatggtttccagtttcatccatgtccgtgcaaaggacattaactcatcctttttttatggctgcatagtattccatggtgtatgtgtgccacattttcttaatccagtctatcattgatggacatttgggttggttccaagtctttgctattgtgaatagtgctgcaataaacatatgtgggcatgtgtctttatagtagcatgatttataatcctttgggtatatacccagtaaagggattgctgggtcaattgcaatttctagttctagatccttcagggatcgccacagtgtcttccgcaatggttgaattagtttacactcccaccaacagtgtaaaagcattcctacttctcaacatcctctccagcatctgttgtttcctgactttttaatgattgccattctcactggcgtgagatggtatctcattgtggttttgatttgcatttctctgatgaccagtgatgatgagcattttttcatgtgtcttttggctgcatagatgtcttcttttgagaagtgtctgttcatatcctttgcccactttttgatagggttgtttgtttttttcttgtaaatttgttggagttctttgtagattctggatattagctgtttgtcagatgggtagattgcaaaaatcttctcccattctgtaggttgcctgttcactctgatggtagtttcttttgccgtgaagaagctccttagtttaattagatcccatttgtcaattttggcttttgttgccattgcttttggtgttttagtcatgaagtccttgcccatacctatgtcctgaatggtattgcctaggttttcgtctagggtttttatggttttaggtctaacatgtaagtctttatccatttttgtaattatccaatttttgtataagatgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctggtccattggtctatatctctcttttggtaccagtaccatgctgttttggttactgtagccttgtagtatagtttgaagtcaggtagcatgatgcctccagctttgttcttttggcttaggattgtcttggcaatgcaggctcttttttggttccatatgaagtttaaagtagtttttttccaattctgtgaagaaagtcattggtagcttgatggggatggcactgaatgtataaattaccttgggcagtatggccattttcataatattgattcttcctatccatgagcatggaatgttcttccatttgtttgtgtcctcttttatttcattgagcagtggtttgtagttctccttgaagaggtccttcacatcccttgtaagttggattcctaggtattttattctctttgtagcaattgtgaatgggaattcactcatgatttggctctctgtttgtctgttaatggtgtataagaatgcttgtgatttttgcacattgattttgtatcctgagatttgctgaagttgcttatcagcttaaggagattttgggctgagatgatggggttttctaaatatacaatcatgtcatctgcaaacagagacaatttgacttcctcttttgctaattgaataccctttatttctgtctcttgcctgattgccctggccagaactttcaacactatgttgaataggagtggtgagagagggcatccttgtcttgtgccagttttgaaagggaatgcttccagtttttgcccattcagtatgacattggctgtgggtctgtcataaatagctcttattattttgagataagttccatcaatacctagtttattgagagtttttagcatgaagggctgttgaattttgttgaaggccttttctgcatctattgagataatcatgtggtttttgtcgttggttctctttatgtgatggattatgtttattgatttgtgtatattgaaccagccttgcatcccagggatgaagccaacttgatcattgtggataagctttttgatgtgctgctggattcggtttgccagtattttattgaggatttttgcatcgatgttcatcagggatattggtctaaaattctcttttttgttgttgtgtctctgccaggctttggtatcaggatattgttggcctcataaaatgagttaaggaagattccctctttttctattgattggaatagtttcagaaggaatgataccaactgctctttgtacctctggtagaattcagctgtgaatccatctggtcctggactttttttggttggtaggcttttaagtattgcctcaatttcaaagcctattattggtctattcagagattcaacttcttcctggtttagtcttgggagggtgtacatgtccaggaatttatccatttcttctagattttctagttcatttgtgtagaggtgtttatagtattctctgatggtggcttgtatttctgtgggatccatggtgatattccctttatcattttttattgcatctatttgattcttctctcttttcttctttattagtcttgctagtagtgtatcaattttgttgatcttttcaaaaaaccagctcctggattcattgatttttttgaagggttttttgtatctctacctctttcagttctgctctaatcttagttatttcttgccttctgctagcttttgaatttgtttgcgcttgcttctctagttcttttaattgtgatgttgggatgtcaattttaggtctttcctgctttctcttgttgtcatttagtgctatgagtttccctctatacactgctttaaatgtgtcccagagattctggtacattgtgtctttgttctcattgctttcaaagaacatctttatttctgccttcctttcgttttttacccagtagtcattcaggagtaagttattcaatttccatggaattgtgcagttttgagtgagtttcttaatcctgagttctaatttgattgcactgtggtctgagagacagtttgttgtgatttctattcttttacatttgctgaggagtgctttacttccaattatgtggtcaattttagaataagtgtgatgtggtgctgagaagaatgtatattctgttgatttttggtggagagttctgtagatgtctattaggtctgcttggtgcagagctgagttcaactcctggatatccttcttaaccttctatctcgttgatctgtctaatattgacagtggggtgttaaagtctcctattattattgtgtgggagtctaagtctctttgtaggtctctaaggacttgctttatgaatctgggtgctcctgtattgggtgcatatatatttaggatagttagctcttcttgtttaattgatccctttaccattatgtaatggtcttctttgtctcttttgatctttgttgatttaaagtctgttttatcagacactaggattgcaacccctgattttttgttgttttccatttgcttggtagatcttcctccatccctttattttgagccaatgtgcgtctttgcacgtgagatgggtctcctgaataccacacactgatgggtctttactctttatccaatttgccagtctgtgtcttttaattggggcatttagcccatttacatttaaggttaatattgttatatgtgaatttgatcctgtcattatgatgttagctggttattttacctgtcagttgatgcagtttcttcatagcatcgatggtctttacaatttggcatgtttttgcagtggctgatactggttgtttcttgccatgtttagtgctctcttcaggagctcttttagggcagacctggtggtgacaaaatctctcagcatttgcttgcctgtaaaggattttatttcttcttcacttatgaagctcagtttggctggatatgaaattctgggttgaaaagttttttctttaaaaatgttgaatattggcctccactctcttctggcttgtagggtttctgttgagagatccactgttagtttgatgggctttcatttgtaggtaacttgatctttctctctggctgcccttaacattttttccttcatttcaaccttggtgagtctgacaattatgtgtcttggggttgcttttcttgaggagtatatttgtggtgttctctgcatttcctgaatttgaatgttggcctgccttgctaggttggggaaattcttctggataatatcctggagaatgttttccaacttggtttcattctccccatcactttcaggtgcaccaataaaaggtagatttggtcgtttcacatagtcccctacttcttggaggcattgttcatttctttttactctttttttaatctaaccttgtcttctcactttatttcattaatttgaccttcaatcactgatatcttttcttccacttgattgaattggccgttgaagcttatgcatgcatcacgaagttctc

SEQ ID NO: 12552 - DNA, 6039 bp, Homo sapiens
ttttcttttttttttttttttaattatactttaagttttagggtacatgtgcacactgtgcaggttagttacatatgtatacatgtgccatgctggtgcactgcacccactaactcgtcatctagcattaggtatatctcctaatgctatccctcccctctccccccaccccaccacagtccccagagtgtgatattccccttcctgtgtccatgtgatctcactgttcaattcccacctatgagtgagaatatgcggggtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatatgtgtgcatgtgtctttatagcagcatgatttatagttctttgggtatatacccagtaatgggttggctgggtcaaatggtatctctagttctagatccctgaggaattgccacactgacttccacaatggttgaactagtttacagtcccaccaacagtggaaaagtgttcctatttctccacatcctctccagcacctgttgtttcctgactttttaatgattgccattctaactggtgtgagatggtatctcatagtggttttgatttgcatttctctgatggccagtgatgatgagcatgttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaatgttctcccattttgtaggttgcctgttcactctgatggtagtttcttttgctgtgcagaagctcttcagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataagatgtaaggaagggatccagtttcagcttcctacatatggctagccagttttcccagcaccatttattaaatagggaatcctttccccattgcttgtttttctcaggtttgtcaaagttcagatagttgtaggtatgcggcgttttttctgagggctctattctgttccattgatctatatctctgttttggtaccagtaccatgctgttttggttactgtagccttgtagtatagtttgtagtcaggtagtgtgatgcctccagctttgttcttttggcttaggattgccttggtgatgcgggctcttttttggttccatatgaactttaaagtagttttttccaattctgtgaagaaagtcattggtagcttgatggggatggcattgaatctgtaaatgaccttgggcagtatggccattttcacgatattgattcttcctacccatgaacatggaatgttcttccatttgtttgtatcctcttttatttccttgagcagtggtttgtcgttctccttgtagaggtccttcacatcccttgtaagttggattcctaggtattttattctctttgaagcaattgtgaatgggagttcactcctgatttggctctctgtttgtctgttgttggtgtataagaatgcttgtgatttttgtacattgattttatatcctgagactttgctgaagttgcttatcagcttaaggagattttgggctgagacaatggggttttctagatatacaatcacgtcatctgcaaacagggacaatttgacttcctcttttcctgactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtgatagataggtcttattattttgaaatatgtcccatcaatacctaatttatggagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgtccggctttggtatcagaatgatgctggcctcataaaatgcgttagggagaattccctctttttctattgattggaatagtttcagaaggaatggtaccagttcctccttgtacctctggtagaattcggctgtgaatccatctggtcctggaccctttttggttggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcagttttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtggtataaatttccctctacacactgctttgaatgcatcccagagattctggtatgttgtgtctttgttctcgttggtttcaaagaacatctttatttctgccttcattttattatgtacccagtagtcattcaggagcaggttgttcagtttccatgtagtggagcggctttgagtgggattcttaatcctgagttctagtttgattgcactgtggtctgagagatagtttgttataatttctgttcttttccatttgctgaggagagctttacttccaactatgtggtcaattttggaataggtgtggtgtggtgctgaaaaaaatgtatattctgttgatttggggtggagagttctgtagatgtctgttaggtccgcttggtgcagagctgagttcaattcctgggtatccttgttgactttctgtctcgttgatctgtctaatgttgacagtggggtgttaaagtctcccattattaatgtgtgggagtctaagtctctttgcaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatatgtgtctctgcacatgagatgggtttcctgaatacagcacactgatggatcttgactctttatccaattttccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctcgtaccggttgttccttttcatgtttagcgcttccttcaggagctcttttagggcaggcctggtggtgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcttttcaactttggtgaatctgacgattatgtgtcttggagttgctcttctcgaggagtatctttgtggtgttatctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatctcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagcttccagtttttctgttctgttttttccccatctttgtggttttatctacttttggtctttgatgatggtgatgtccagatgggtttttggtgtggatgtcctttctgtgtgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtatgcccgttctcagatctccagctgcgtgctgggagaaccactgctctcttcaaagctgtcagacagggacatttaagtctgcagaggttactgctgtctttttgtttgtctgtgccctgtccccggaggtggagcctacaagaggcatgcaggcctccttgagctgtggtgggctccacccagttcgagcttccaggctgctttgtttacctaagcaagcctgggcaatggcgggcgaccctcccccagcctcgctgctgcctggcagtttgatctcagactgctgtgctagcaatcagcgagactccgtgggcgttggaccctccgagccaggtgtgggatatagtctcgtggtgcgccgttttttaagccggcctgaaaagcgcaatatttgggtgggagtgacccgatttccaggtgcgtccgtcacccctttctttgactcggaaagggaactccctgaccccttgtgcttcccaggtgaggcaatgccttgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccagagctgttcctattcggccatctttgctcctccc

SEQ ID NO: 12553 - DNA, 6052 bp, Homo sapiens
cctgatcttttttttttttttaatttttattttttattatactttaagttttagggtacatgtgcacattgtgcaggttagttacatatgtatacatgtgccatgctggtgcactgcacacactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatctgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttcagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcgtatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggtttttgaattttgtcaaaagctttttctgcatgtattgagataatcatgtggtttttgtctttggctctgtttatatgctggattacatttattgatttgcgtatattgaaccagccttgtatcccagggatgaagcccacttgatcatggtggataagctttttgatgtgctgctggattcggtttgccagtattttgttgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagttttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccaactcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacagtgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttagtatagttagctcctcttgttgaattgatccctttaccattatgtaatggccgcctttgtctcttttgatctttgttggtttaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggttattttgctcgttagttgatgcagtttcttcctagtctcgattgtctttacattttggcatgattttgcagcagctggtaccggttgttcctttccatgtttggcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttctctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctaggttggggaagttctcctggataatatcctgcagagtgttttccaacttggttccattctccgcatcactttcaggtacaccaatcagacgtaaatttggtcttttcacgtagtcccatatatcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagcctttttctctcagctcgtcaaaatcattctccatccagctttgttccgttgctggtgaggagctgtgttcctttggaggaggagaggcgctctgcgttttacagtttccagtttttctgttctgttttttccccatctttgtggttttatctacttttggtctttgatgatggtgatgtacagatgggttttcggtgtggatgtcctttctgtttgttatttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaggtctgcagaggttactgctatctttttgtttgtctgtgccctgcccccagaggtggagcctacagaggcaggcaggcctccttgagctgtggtgggctccacccagttcgagcttcctggctgctttgtttacctaagcaagcctgggcaatggggggcgcccctcccccagcctcgctgctgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgtgtcgctcacgctgggagctgtagaccggagctgttcctattcggccatcttggctcctccc

SEQ ID NO: 12554 - DNA, 5728 bp, Homo sapiens
tttctttctttttattttttattatactttaagttttagggtacatgtgcacactgcacaggtttgttatatacgtatacatgtgccatgttggtgtgccgcacccattaactcatcatttagcattaggtatatctcctaatgctatccctcccccctccccccaccccacaacaggccccagtgtgtgatgttccctaccctgtgtccaagtgttctcattgttaaattcccacctgtgagtgagaacatgcggtgtttggttttctatccttgcgatagtttgctcagaatgatggtttccagcttcatccatattcctacaaaggacatgaactcatcattttttacggctacatagtattccatggtgtatatatgccacattttcttaatccaatctgtcattgttggacatttgggtaggttccaagtctttgctattgtgaatagtgccacagtaaacatacgtgtgtgtgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagacggtatctcattgtggttttgatttgcatttctctgatggccagtgatgatgaacattttttcatgtgtcttttggctgcataaatgtcttcttttgagaagtgtctgttcataccctttgcccactttttgatggggttgtttgtttttttcttgtaaatttgtttgagttcattgtagattctggatattagccctttgtcagatgagtaggttgcaaaaattttctcccattctataggttgcctgttcgctctgatggtagtttattttgctgtgcagaagctctttagtttcattagatcccatttgtcaattttggcttttgttgccattgctttcggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagatttctacatatggctagccagttttcccagcaccatttattaaatagggaatcctttccccatttcttgtttttgtcaggtttgtcaaggatcagatagttgtagatatgcggcattatttctgagggctctgttctgttccattggtctatatctctgttttggtaccattaccatgctgttttggttactgtagccttgtagtatagtttgaagtcaggtagtgtgatacctccagctttgttcttttggcttaggattgacttggcaatgtgggctcttttttggttccatatgaactttaaagtagttttttccaattctgtgaagaaagtcattggtagcttgatggggatggcattgaatctgtaaatttccttgggcagtatggccattttcacaatattgattcttcctacccatgagcatggaatgttcttccatttgtttgtatcctcttttatttcatagagcagtggtttgttgttctccttgaagaggtccttcacgtcccttgtaagttggattcctaggtattttattttctttgaagcaattgtgaatgggagttcactcatcatttagctctctgtttgtctgttattagtgtataagaatgcttgtgacttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttattttcttctcctgcctgattgccctggccagaacttccaacactatgttgaataggagtggtgagagagggcatccctgtcttgtgccagttttcaaagggaatgcttccagtttttgcccattcagtatgatattggctgtgggtgtgtcatagatagctcttattattttgagatacgtcccatcaatacctaatttattgagagtttttagcatgaagggctgttgaattttttcaaaggccttttctgcatctattgagataatcatgtggtttttgtctttggttctgtttatatgctggattatgttttttgatttgcatatgttgaaccagccttgcatcccagggatgaagcccacttggtcatggtggataagctttttgatgtgctgctggattcggtttgccagcattttattgaggagttttacatcaatgttcatcacggatattggtctaaaattctctttttttgttgtgtctctgccaggctttggtatcaggatgatgctggcctcataaaatgagttagggaggattccctcttttctgttgattggaatagtttcagaaggaatggtaccagctcctccttgtacctctggtagaattcggctgtgaatccatctggtcctggactttttttggttggtaagctattaattattgcctcgatttcagagcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctgtgggattggtggtgatatcccctttatcattttttattgcatctatttgattcttctctcttttcttctttattagtcttgctagcagtctatcaattttgttgatcttttcaaaaaaccagcccctggattcattgattttttgaaggtttttttgtgtctctatttccttcagttctgctctgatcttagttatttcttgccttctgctagcttttgaatgtgtttgctcttgcttttctagttcttttaattgtgatgttagggtgtcaattttagatcttccctgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagggctttacttccaactatgtggtcagttttggaataggtgtggtgtggtgctgaaaagaatgtatattctgttgatttggggtggagagttctgtagatgtctattaggtccgcttggtgcagagctgagttgaattcctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtagtggccttctttgtctcttttgatctttgttggtttaaagtctgttttatcagagactaggattgcaacccctgcctttttttgttttccatttgcttggtagatcttcctccatccatttattttgagcctatgtgtgtccctgaacgtgaaatgggtttcctgaatacagcacattgacgggtcttgactctttatccaatttacccgtctgcatcttttaattggagcatttagcccatttacatttaaggttaatattgttatgtgtgaatttgatcctgtcattatgatgttagctgatgatttggctcgttagttgatgcagtttcttcctagccttgatggtcgttaccatttggcatgtttttgcagtggctggtaccagttgttcctttccatgtttagtgcttccttcaggagctcttttagggcaggcctagtggtgacaaaatctctcagcatttgcttgtctgcaaagtattgtatttctccttcacttatgaagcttagtttggctggatatgcaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtatcttggagttgctcttctcgaggagtatctttgtggcattctctgtatttcctgaatttgaatgttgtcctgccttgctagattggggaagttctcctggataatatcctgcagagtgttttccaacttggttccactctccccatcactttcaggtacaccaatcagacgtagatttggtcttttcagatagtcccatatttcttggaggctttgttcatttctttttattcttttttctctaaacttctcttctcgcttcgtttcattcatttgatcttccatcactgataccctttcttcccgttgatcgaatcggctactgaggcttgtgcattcgtcacgtagttctcgtgctgtggttttcagctccatcaggtcctttaaggacttctctgcattgattattctagttagccattcgtctaatcttttttcaaggtttttaacttctttgccatgggttcgaacttcctcctttagctcggagtagtttgatcttctgaagccttcttctctcaactcgtcaaagtcattctccgtccagctttgttccattgctggtgaggagctgcgttcctttggaggaggagaggtgctctgatttttggagtttccagtttttctgctctgttttttccccatctttctggttttatgtacctttggtctttgatgatggtgatgtacagatggggttttggtgtggatgtcctttctgtttgttaggtttccttctaacggtcaggaccctcagctgcaggtctgttggagtttgctggaggtccactccagaccctgtttgcctgggtatcagcagcagaggttgcagaacagtggatattggtgaacagcaaatgttgctgcctgatagttcctctggaagttttgtctcagaggggtacccagctgtgtgaggtgtcagtctgcccctactgggggtgcctccctgttaggctattcgggggtcagggactcacttgaggcagtctgtccgttctcagatctcaagctgcgtgctgggagaaccactactctcttcaaagttgtcagacagggacatttaagtctgcagaggtttctgctgccttttatttggctatgccctgcccccagaggtggagtctacagaggcaggcaggcctcctggagctgtagtgggcttcacccagtttgagcttccctgctgctttgtttacctactcaagcctcggcaatggcaggcgcccttcccccagcct

SEQ ID NO: 12555 - DNA, 20507 bp, Homo sapiens
agattctttttttttttttattatactttaagttttaggggacatgtgcacattgtgcaggttagttacatatgtatacatgtgccatgctggcgcactgcacccactaactcgtcatctagcattaggtatatctcccaatgctatccctcccctctccccccaccccacaacagtccccagagtgtgatattccccttcttgtgtccatgtgatctcactgttcaattcccacctatgagtgagaatatgcagtgtttggttttttgttcttgcgatagtttactgagaatgatgttttccaatttcatccatgtccctacaaaggacatgaactcatcattttttatggctgcatagtatgccatggtgtatatgtgccacattttcttaatccagtctgtcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtattcccagttctagatccctgaggaatcgccacactgacttccacatggttgaactagtttacagtcccaccaacagtgtaaaagtgttcctatttctccacatcctttccagcacctgttgtttcctgactttttaatgattgctattctaactggtgtgagatggtatctcattgtggttttgatttgcatttctctgatggccagtgatgatgagcattttttcatgtgttttttggctacataaatgtcttcttttgagaagtgtctgttcatgtccttcacctgctttttgatggggttgtttgtttttctcttctaaatttgtttgagttcattgtagattctggatattagccctttgtcagatgagtaggttgcgaaaattttctcccattttgtaggttgcctgttcactctgatggtagtttcttttgctgtacagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttttcaaagatcagatagttgtagatatgcggcgttatttctgagggctctgttctgttccattgatctatatctctgttttggtaccagtaccatgctgttttggttactgtagccatgtagtatagtttgaagtcaggtagtgtgatgcctccagctttgttcttttggctcaggattgccttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtaggtctccttgaagaggtccttcacatcccttgtaagttggattcctaggtattttattctctttgaagcaattgtgaatgggagttcactcatgatttggctctctgtttgtctgttgttggtgtataagaatgcttggatttttgtacattgattttgtatcctgagactttgctgaagttgcttatcagcttaaggagattttgggctgggacaatggggttttctagatatacaatcatgtcgtctgcaaagagggacaatttgacttcctcttttcctaattgaataccctttatttccttctcctgcctaatagccctggccagaacttccaacactatgttgaataggagtggtgagagagggcatccctgtgttgtgccagctttcaaagggaatgcttccagtttttgcccattcagtatgatattggctgtgggtttgtcatagataactcttattattttgaaatacgtcccatcaatacctaatttattgagagtttttagcatgaaggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttcttgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatgccaccagttcctccttgtacctctggtagaattcagctgtgaatccatctagtcccagactctttttggttggtaagctattgattattgccgcaatttcagagcctgttattggtctattcagagattcaacttcttcctggtttagtcttgggagagtgtttgtgttgaggaatttatccatttcttctagattttctagtttatttgggtagaggtgtttgtagtattctctgatggtagtttgtatttctgtgggatcggtggtgatatcccctttatcattttttattgcatctattagattcgtctctctttttttctttattagacttgctagcggtctatcaattttgttgatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttatttgtgttgttagggtgtcaattttggatctttcctgctttctcttgtgggcatttagtgctataaatttccctctacacactgctttgaatgcgtcccagagattctggtatgttttgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttcccagtatgtggtcagttttggaataggtgtggtgtggtgctgaaaaaaatgtatatcctctttatttggggtggagagttctgtacatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatgtatatttaggatagttagctcttcttgttgaattgatccctttaccattatgtaatggccttctttgtctcttttgatctttgttggtttaaagtgtgttttatcagatactaggattgcaacccctgcctttttgtgttgtccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttcgctggatatgaaattctgggttgaaaattcttttcattaagaatgttgaatattggcccccactctcttctggcttgtagggtttctgccgagagatccgctgttagtctgatgggcttccctttgagggtaacccaacctttctctctggctgccgttaacattttttccttcatttcaactttggtgaatctgacaattatgtgtctcggagttgctcttctcaaggagtatctttgtggcgttctctgtatttcctgaatctgaacgttggcctgccttgttagattggggaagttctcctggataatatcctgcagagtgttttccaacttggttccattctccccatcactttcaggtacaccaatcagacgtagatttggtcttttcacatagtcccatatttcttggaggcttggctcatttctttttattcttctttctctaaacttcccttctcgcttcatttcattcatttcatcttccatcgctgataccctttcttccagttgatcacattggctcctgaggcttctgcattcttcacgtagttctcgagccttggttttcagctccatcaagtcctttaagcacttctctgtattgttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttctgttgctggtgcggaactgcattcctttggaggaggagaggcactctgctttttagagtttccagattttctgttcagttttttccccatctttgtggttttatctacttttggtctttgatgatggtgacgtacagatgggtttttggtgtggatgtcctttctgtttgttagttttccttctaacagacaggaccctcagctgcaggtctgttggtataccctgctgtttgaggtgtcagtgttgccctgctgaggggtgcctcccagttaggctgctcaggggtcaggggtcaggggtcagggacccacttgaggaggcagtctgcccgttctcagatctccagctgagtgctgggcgaaacattgctctcttcaaagctgtcagacagtgacatttaagtctgcagaggttactgctgtctttttgtttgtctgtgccctgcccccagaggtggagcctacagaggcaggcaggcctccttgagctgtggtgggctccacccagttggagcttcctggctgctttgtttacctaagcaagcctgggcaatggcggacacccctcccccagcctcactgccgccttgcagtttgatctcagactgctgtgctagcaatcagcgagactccgtgggcatagtaccctcccagccacgtgcgggatataaactccgccgttttttaagcctgtcggaaaagcgcagtatttggatgggagtgacccgattttccaggtgctgtcagtcacccctttctttgacttggaaagggaactccctgaccccttgcgcttcccgagtgaggcaatgcctcgccctgctttggctcgcgcacggtgcgcgcacccactgacctgcgcccactgtctggcactccctagagagatgaacccggtacctcagatggaaatgcagaaatcaccgtcttctgcgtcgctcatgctgggagctgtagaccggagctgttcctattcggccatcttggctcctcccagcaggtttgaagattcttttacatttatttttgctgttctaatgggctttaatatgagacaattttttgaaaaatgctgatatattaataaaagggaaattcattatatccatacccaatattctgttctgagcaacactgaaacaaagctttggagaaagagaggctttctgtttatcatctcttatgttataaaagtgttcttaaaatacctttattttctatgtcaattaaaattgctttgtagtagtgttgtatatcatctggattactcagctcacagatatttttgcagtactcaattatgttatggagactggcttatgcacgaatctttctaatggttatatataaagcacttgaagtctctattattttataataggcaatacctagataaataatgaatttaactcatctttcttatgtgactctaaaggtcaaatcataccacctgaatatttttatcctctctgaatatttccattaaagagtttatttaaaagaatttttaaatcttctcattatgtcttaacagcatgatatcatactctactttttgacttctccatttgatatggaataaaattgcatcatatggccaaggcatatacacttaaagtcttcaatttagaagctttccagagtcaaactgagtcaatctctactttagaagtctcccacaaaaaggatcctacataaattattgtgtgtttaaaggtttctgattttaatctaataactgaaatatcaaaactatattttaattcaggcatttgggcatcactaccaggtgttctcatcagatttaggaaccctgcagcaagatttatcagtgtcaaaatgctaaaatcctaaatttagtgccagaatccctctcaaatggcatttatattttgatagcttaacctactttgaatcccctgagcatcttgtctgtttttattagtagattttgctgatcttttttaacttttcaaaggctctttaaattatcctaaagtcatatatttaccatgagaaagcaggtgtctttttagagtgtagatgcttaagtcgctcataaaattaatttcctcgggttaggagaacattttgaaactctaatttgaaaaactctaatctggcttctaaaaacactgtatcagtattcagaaataataaaaacggaaacataacaacataataaatttaatttaacctagcatagcaaaagagtagggcatttttgcataatcagctagatatttttcagaggcaaataaagagcagtggagactttgtttggagacagccattgtttcaagaaatgggtgttgccttgatgaagctacccttgcttgtctctgcagatccgtctcctgctatcaccagctctgtgttaacattgcctatgctgtggacacacagagatacttgacagtcagtggatgaactcaataaatgttattatttttaaatacacagcttactaaacagataaataatcttaaaattgagaccgttccagaaaccagaatgcattttcttcatactcatagcttttgtggtttacatacatttatataattagaatgcaataaaatacattaaacagtaaaataatactctatataatttaatctctggggatccagaaggcactttaagctattacagtttctcagagtcaatgttatgtactttataattttttattctactggtaaaacatggtgatattgattaacagagattttagtagatataatattttataaactgattttattatgtcttgttaatattgggataatcagaatatagagagacttctatacatacacatatattctatatcttcatagctagacttgaagtatctcactttgatgtttctaaaaataaagtgagcactttgttctttttaatattttatttatttacgtatttatttatttatttttgagatgcagtcttgctctgtcaaccaggctggaatgcagtggtacaatattggctcactgcaaactctgccttcctggttcaagcgattctcctgcctcagcctcctgagtagctgggattacaggctactgccaccacacctggttaattttattttgtgtgtgtatttttagtagagacagggttttaccatgttgcccagtctggtctcgaactcctgacctcaggtgatctgcccaccttggcctcccaaagtgctgggattacaggcatgagccactatgcccagcccactttgtccttcaatttcttccttcttcttcattttgacccccagtttacatcattaagtacatagtctcgaaacctcaaagtatcagtgtcatccttatttgttttttttcctccttctctgaatttgcctgatagtcaaaacctgtgcctactaccacttaaaggttttttttttcatctgtctgactagattgtccactatctcaccaaatcttgctttgactagtaataatggcagttgagagtactgcctatcacttgaccagactttagctaaatgctgaacattcattataatatttaaatctttaaaccaaccttgatttttattttgatttatgagatgactctaccaaaggttagattctgattttggagagctagatcataatagagtcagaattaaaatctgttcttaacttctacactgtactccaacaacagtcaaactgttactttctcattcagggtaaaatcctgaccaaacccattactgaaaaccttccttttttatctcagctcccagtctccaccccatgtatctgatacacctgtgacaatgatcttttctccatatctagaaaatatcaccaacttacagtgccgtgttatggtataggctcttatttccacttcctttcatcacagttctatttatttctcaatacactgttgaagatcagttgaaatatcaatttcagcataacttcccatactttaggggcataatttaatagcttaccagacagtagcatataatgtagtgacttgggagccagacttcctgggtttgaatacaggatgaaaattcaccagtcttttgaccttgggaaagttactaaaccttcctatacaccagtttcctcatctgtgaaatgaggcaaattatagcacctacctcttagggttgttataaaccttaaatcagttagtacaagtaaaggccttagaacagcacctggcacattgtaagaaatgtctaaaggttcattgctatcatttattcatttccacatctcattcctaaaattaaaggtgttataaaattgccagtataattagaaaaaaaatgggaaaatgtgttaaagaaaaattataaacaaatttgaagaaaatgtagaataatacatatatatcttaggaggaaatctcttaagcatatagaaaattaagaaactatgaaacaagattaacatagttgactatacacaaactttaattgctaatacaggcatactttgttttatgctttgctttattgcacttcacagaatttttttagaaattgaagttttgtggcaagcttgcatccagcaagtccatcagcaccattttcccaaaagcctgtgctcactttctgtctctgtgtcacatttggtaattctcacagtatttcaaacttttaaattattattatatctgttatggtgttctgtgatcagtgattttccatgttagtatggtaattgctttgaggcatcacaactcatgcccatataagatggcaaacttaattgataaatgtgtatgttctgactactccaaagactggccattccccatcttccttcccctcctcaggccaccctactccctaagacacaacaatatggaaactaggtcaattaataatcctacgtggccctctaaatgttcaggtgaaaagactaatgaagaaggcatgttgaagttgagataggctaaaagctaggcctcttgtgccaaacatttagcaaagatatgagtgcagagaaaaaattcttgaaggaaattaaaagtgctactccaatgaacacatcaatggtaaggaagcaaaacaggcttattcatgatatggagaaagttttagtgatccggatagaataccaagccagccacaacattctcctaagccaaagcctaatccagagcaaagccctaactgtcttcaattctgtgaaggttgagagaggtgaggaagctttggaagaaaagtttgaagctagcagaggttggctcataaggtttaagaaaagaagctgtatctgtaatataaaagtgcaaggtgaaacagcaagtgctagtgtagaagcaggagtgagttatccagaagatctagctaagataactgatgaagatggctacattaagcaacagattttcaatgtagacaaaacaacctatattgaaagaagatatcatctaggactttcatagtaagagagaagtcaatgtctggtttcaaagcttcagaggacaggctgatgtgattcttaggggctaatgcagctagtaacttctaattgaagccaatacttatttgccattccaaaatccctaggacccttcagaattgtgcaaaatctactctgcctatgctctataaatggaatgacaaagcctagatgatagcacggtatacaaatattttaagcccagtgttaagacctactgctcagaaaaaagatttctttcaaaatattattgcacattgacaataacttaatcacccaagagctctgacggagaggtacaaggaaattaatgttttcatgcctgctaataaaacatcaattgtgcagcccatggatcaaagagtaatttttactttcaagtcttattacttaagaaatatatttcataatgctatatttgccatagatagtgatttccccaatggatctgggcaaggtacattgaaagccttctggaaagggtttaccattctagaagtcattaagaacatttgtgattcatgagaacaggtcaaaaatcaacattaacagaaatctggaagaagttaattccaaccctcatagattactttgaggggttttagatttcagtggagaaaatccctgcagatgttgtggaaacagcaggagaactagaattagaagtaaagcctgcctgggaggggaaggacacgcaccggagcctgttaggggatgggaagtaataggagggagagtattaggaccaatacctaatgcatgtggggcttaaaacctagatgacaggttaataggtgcaggaaaccatcatggcacatgtatacttatgtaaacaatcctgcactttctgcgcgtgtatccaggaacttaaagtaaaattaaaaaaaaaaaaaaagaagtaaagcctgaagatgtgactgaatcactacagtctcatgataaaactttagcaaataaggagttgcttcttatggatgagcaaagaaataagtttattgaaatggaatctattcctggtgaagatgctgtgaacattattgaaatgataacaaaattctagaatatttgataaactttatcagcagcatcagaatttgaaaaatttgactcgaattttgaaagaggttctactgtaggtaaaatgctatcaaacagcatcacctgctatggagaaatctttcatgaaaggaagagtcagtagatgtggcagacttcattgttgtcttattttagaaattgccacagccaccccatccttcagcaaccaccaccctgatcagtcagtagctatcattgtcaaggcaaggtcctccatcagcaaacagatgaagactggcttgaaagcgaaagtgatcattaacatttcttaataaaacattttcattaaggtatgcaggttattttttagaaataatactattacataattaatagactatagtatagcataaacataacttttatatgcactggaaaatcaaaagaatcatgtgacctgctttattgtgatatttgctctattgcggtgatctggatccaaatttgcagcttctgcaaggtatgcctgtgtagggaaaggcagcacaaactaaactacaatagaagtgacagagcacagagcaaaagagtatacttttaacatatgtgttaaataaatgtttaatacacacatcaaatacagaacctctagaagtcaatataatttaaaatgcaaacacataaaataataagcaaaactctaaatattcaacataaatgatataaaaatgtcctataaacctttaaaaatacttatttaaataacctgcaataactttgccccttaaatagggtaaatttatatagatcagcactaatttaattttggcatgtatctgaagaaatgataaatattacacattgtttatgatggtataaattgcaatattattaaaggatacatggaatctattaaaatgtttggaagtggatatatcttatgattgatttgattgatacagcaattcctcttttgtgtgtcttatacacacacatacataatatacacttaggcaaacacatttcagacgtttggattgggatcttggctgctgcttcaacctcatctaatttcctattacacctcctctctctccctttttgtacatttgtccctctctctgatttccaccatctgtctttccagtttactttctctagctccagacaacaaaaattctttaatcccactgggatctccaatcaattgattcaatcaacttttcattatgcctcaaccctttgatcttctaatctaacttctcataactcaagttaaattccatgggaaatccttaacaatcacttccacatatacatccttaactgcctgcctccctcttattgctttgacttgtttggaaaaaccacaacttggttaaatccagatcaccattctctatgtctataattctgcagctaaacataggtagagatcaatacacaaccatcatttctcatcttaaattcgtaaccacaaacctcatagagatctgttaatgctagtcaggcaattacagtgtttcccattcctttaattccttcactatcctgtttcaatttcacacctttttctgctttcttatatgtaaaacacctcctccctgtccttactctcaagtgatcactgtacatctgatttcatgaagaatattcaaatgattaaaagaaaacatcacagattcccatcaccacgtctgcccccacaccgtttacaaacccacactccctgctgcccatcttgttgccccaggtgaactatctgaactactatctaaagtcagtttcttcccacgtgcactacattccagcagcttttacttagcaaagaacattttccagcaatttccttgtctctcctttaacaccattttctccccttttcctactggatcattctcatcagcatgtaaacaagttattacttgtttcccaacctgaccacatttttcatcttccatctccgtaaatctgatctgtgccccactatttatttcctgaatttccatgatggccttttacctgatcttcctgcatgtgtcctctcaccctacacaatctattcccagcatggcagtcagaaacaaccttttaaaacagaagccaggtcttgcgcctcctattctgaaatcctcactggttttcccccaccccacccctcatgtcactcagagtaaaccctaagttcgcatgtgcctgacagggtcttacataacctacccgcccccacagcccagacctctctgatcttctggaccattgttgtcctcattgatcactctgctccagctacaactgtctgctgctctccctccaccttcccaactgaaggcttttgtgcttgttgtttctgtcctgaaaatgaacttctataatgtggttaactttcccttatctcattcaagtatttgctcaagtctttttcagtaagacaggccctaatcatcttatttaaaactggaacatacactcccactccctacacttctgcacccatttactttgctctgctttttcttttttcatagaatgtgtcacattataatactacatagtttactttttactatttatcattttattacctatcccggtcattacattttgagattcaggagtacaaaaatctttgactcttttgttcactgatgaatcacaaaaaaaaaaaaaacaaacccatcaactataacctataaaaaacctataaactataaaataacctatagaaaaacatatgatcacaaaaaaacctataacctatcagcaagaaaattggcatcaattaatacttgctaagtgaattaatgtatttgtgcaaaatatatatacagaagcatgtctggtgtatccttgttttattttattttttattttttatttttttatttttttcaattttaactattattaacgaacatttatacatttatatgcttttccattttctacactattataaataagtgtgatgaatatctttgtaagtctttgatgatacatgtgatgatttccttaggacagattcctagaagtggaattcctggatgcaagaacatgacttttctttttctttctttctttttttttaattttatttttattttattattattatactttaagttttagggtacatgtgcacaatgtgcaggtttgttacatatgtatagatgtgctatgttggtgtgctgcactcattaactcgtcatttagcattaggtatatctcctaatgttatttttccccccttcccctaccgcacaacagtccctgacgtgtgatattccccttcctgtgtccatgtgttctcactgttcaattcccatctatgagtgagaacatgcagtgtttggttttttgtccttgcagtagtttgctgagaatgatggtttccagtttcatccatgtccctacaaaggacatgaactcatcattttttatggctgcatagtattccatggtgtatatgtgccacgttttcttaatccagtctattgttgttggacatttgggttggttccaagtctttgctattgtgaatagtgccgcaataaacacgtgtgcatgcgtctttatagcagcatgatttataatcctttggggatatacccagtaatgggatggctaggtcaaatggtatttctagttctagatccctgaggaatcgccacactgacttctacaatggttgaactagtttacagtcccaccaacagtgtaaaagtgttcctatttctccacatcctctccagcacctgttttttactgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttctcccactgtttgatggggtggtttgtctttttcttgtaaatttgtttgagttcattgtagattctggatattagacctttgtcagatgagtaggttgcaaaaattttctcccagtttataggttgcctgttcactctgatggtagtttcttttgctgtgcagaagctctttagtttaattagatcccatttgttgattttggcttttgttaccattgcttttggtcttttagacatgaagtccttgcccatgcttatgtcctgaatggtattgcctaagttaccttctagggtttttatggttttaggtctaacatgtaagtctttaatccatcttcaactgatttttgtataaggtgttaggaaaggatccagtttcagctttctacatgtgactagccagttttcccagcaccatttattaaatagggaatcctttccccattgcttgtttttgtcaggtttttcaaagatcagatggttgtagatatgcggcattatttctgagggctctgttctgttccattgatcaatatctctgttttgataccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcacgatattaattcctcctacccatgagcatggaattttcttccatttgtttgtatcctcttttatttccttgagcagtggtttgtagttctccctgaagaggtccttcacatcccttgtaagttggattcctaggtattttattctttttgaagcaattgtgaatgggagttcactcatgatttgactctctgtttgtctgttattggtgtataagaatgcttgtgatttttgcacattgattttgtatcctgagactttgctgaagttgcttatcagcttaaggagattttgggctgagacaatggggtctgctagatatacaatcatgccatctgcaaagagggacaatttgacttccccttttcctaactgaataccctttatttccttctcctgcctaatcgccctggccagaacttccaacactatgttgaataggagtggtgagagagggcatccctgtgttgtgccagctttcaaagggaatgcttccagtttttgcccattcagtatgatattggctgtgggtttgtcatagatagctcttattattttgagatacgtcccatcaatacttaatttattgagagtttttagcatgaagggttgttgaattttgtcaaaggctttttctgcatctattgagataatcatgtggtttttgtctttggttctgtttatatgctggattacatttattgatttgcatatgttgaatcagccttgcatctcagggatgaagcccacttgatcatggtggataagctttttgatgtgctgctggatttggtttgccagtattttcttgaggatttttgcatcaatgttcatcaaggatattggtctaaaattctcttttttggttgtgtccctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcccagactctttttggttggtaagctattgattattgccacaatttcagagcctgttactggtctattcagagattcaacttcttcctggtttagtcttgggagagtgtatgtgtcgaggaatttatccatttcttctagattttctagtttatttgggtagaggtgtttgtagtattctctgatgatagtttgtatttctgtgggattggtggtgatatcttctttatcattttttattgcgtctatttgattcttctctcttttcttctttattactcttgctagtggtctatcaattttgttgatcttttcaaaaaaccagctcctagattcattaatttttgaagggtttttttgtgtctctatttccttcagttctgctctgattttagttatttcttgccttctgctagctttcgaatgtgtttgctcttgcttttctaattcttttaattgtgatgttagggtatcaattttggatctttcctgctttctcttgtgggcatttactgctataaatttccctctacacactgctttgaatgtgtcccagagattctggtatgttttgtctttgttctcgttggtttcaaagaccatctttatttctgccttcattttgttatgtacccagtagtcactcaggagcaggttgttcagtttccatgtagttgagcggttttgagtgagtttcttaatcctgagttctagtttgattgcagtgtggtctgagagacagtttgttataatttgtgttcttttacatttgctgaggagagctttacttcccagtatgtggtcagttttggaataggtgtggtgtggtgctgaaaaaaatgtatatcctctttatttggggtggagagttctgtagatgtttattaggtcttcttggtgcagagctgagttcaattcctgggtatccttgttaactttcagtctcgttgatctgtctaatgttgacagtggcgtgttaaagtctcccattattattgtgtgggagtctaagtctctttgtaggtcactcaggacttgctttatgaatttgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtatcttttaattggagcatttagcccatttacatttaaagttaatattattatgtgtgaatttgatcctgtcattatgatgttagctggttattttgcttgttagttgatgcagtttcttcctagccttgatggtctttacattttggcatgtttttgcagtggctggtaccgtttgttcctttccatgtttagtgcttccttcaggagctcttttagggcaggcctggtggtggcaaaatctctcagcatttgcttgtctgtaaagtattttatttctccttcacttatgaagcttagtttggctggatatgagattctgggttgaaaattcttttctttaagaatgttgaatattgatccccactctcttctggcttgtagagtttctgccgagagatccgctgttagtctgatgtgcttccctttgtgggtaacccaacctttctctctggctgcccttaacattttttccttcatttcaactttggtgaatctgataattatgtgtcttggagttgctcttctcgaggagtatctttgtggtgttctctgtatttcctgaatctgaatgttggcctgccttgccagattgggaaagttctcctggataatatcctgcagagtgttttccaacttggttccattctccccatcactttcaggtacaccaatcagacatagatttggtcttttcacatagtcccatatttcttggagggtttgttcttttctttttattcttttttctctaaacttcccttctcgcttcatttcattcatttcatcttccatcgctgatacccattcttcccgttgatcgcattggcttctgaggcttctgcattattcacgtagttctcgagccttggctttcagctccatcaagtcctttaaggacttctctgcattggttattctagttatccattcgtctaattttttttcaaagtttttaacttctttgccattggtttgaatttcctcctgtagctcagagtagtttgatcatctgaagccttcttctctcaactcatcaaagtcattctccatccagctttgttctgttgctggtgaggagctgcattccttgggaggaggagaggtgctctgctttttagagtttccagtttttctgctctgttttttccccatctttgtggttttatctacttttggtctttgatgatggtgacgtacagatgggtttttggtgtggatgtcctttctgtttgttagttttccttctaacagacaggacctcagctgcaggtctgttggagtttgctagaggtcactccagaccctgtttgcctgggtatcagcagcggtgactgcagaacagcagtggctgtagaacagcggatattggtgatccgcaaatgctgctgcctgatcattcctttggaggttttgtctcagaggagtacccggccgtgtgaggtgtcagtctgcccctactggggggtgcctcccatttaggctgctcggggctcagggacccacttgaggaggcagtctgcccgttctcagatctccagctgcgtgctgggagaaacactgctctcttcaaagctgtcagacagggacatttaagtctgcagaggttactgctgtctttttgttcgtctgtgccctgcccccagaggtggagcctacaaaggcaggcaggcctccttgagctgtggtgggctctacccagtttgagcttccaggctgctttgtttacctaatcaagcctgggcaatggcaggcgcccttcccccgccttgctgcccccttgcagtttgatctcagactgctgtgctagcaatcagcgagactccatgggtgtaggaccctccgagccagatgcgggatataatctcctggtatgccgatttttaagcccattggaaaagggcagtattagggt

SEQ ID NO: 12556 - DNA, 6055 bp, Homo sapiens
ttttgttttgctttattttattttattttattttttatactttaagttttagggtacatgtgcacattgtgcaggttagttacatatgtatacatgtgccatgctggtgcgctgcacccactaactcgtcatctagcattaggtatatctcccaatgctatccctcccccctgcccccaccccaccacagtccccagagtgtgatattccccttcctgtgtccatgtgatctcattgttcagttcccacctatgagtgagaatatgcggtgtttggttttttgttcttgcgatagtttactgagaatgatgatttccagtttcatccatgtccctacaaaggagatgaactcatcattttttatggctgcatagtattccatggtgtatatgtgccacattttcttaatccagtctatcattgttggacatttgggttggtgccaagtctttgctattgtgaataatgccgcagtaaacatacgtgtgcatgtgtcttcatagcagcatgatttatagtcctttgggtatatagccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttcatgattgccattctaactggtgtgagatggtatctcattgtggttttgatttgcatttctctgatggccagtgatgatgagcattttttcacgtgttttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcgaaaattttctaccattttgtaggttgcctgttcactcagatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacgtatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggatcgccttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccgtgagcatggaatgttcttccatttgtttgtatccttttatttccttgagcagtggtttgtagttctccttgaagaggtccttcacatcccttgtaagttagattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaacggggttttctagatatacaatcatgtcgtctgcaaacagggacaatttgacttcctcttttcctaattgaataccctttatttccttctcctgcctaattgccctggccaaaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggacattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctcttcagagattcaacttcttcctggtttagtcttgggagagtgtatgtgtccaggaatttatccatttcttctagattttctagtttatttgcgtagaggtgtttgtactattctctgatggtagtttgtatttctgtgggatcggtggtaatatcccctttatcattttttattgtgtctatttgattcttctctctttttttctttattagtcttgctagtgatctatcagttttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttgcatctttcctgctttctcttgtgggcatttagtgctataaatttccctctacacactgctttgaatgcatcccagagattctggtatgttgtgtctttgttctcgttggtttcaaagaacatctttatttctgccttcatttcgttgtgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgtgctgaaaaaaatgtatattctgttgatttggggtggagagttctgtagatgtctattaggtctgcttggtgcagagctgagttcaattcctgggtatcctttttgactttctgtctcgttgatctgtctaatgttgatagtggggtgttaaagtctcccattattaatgtgtgggagtctgagtctctgtgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaaaccctgcctttttttgttttccatttgcttggtagatcttcctccatccttttattttgagcctatgtgtgtctctgtatgtgagatgggtttcctgactacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcagctggtaccggttgttcctttccatgtttagcgcttccttcaggagctcttttagggcaggcctggtggtgatgaaatctctcagcatttgcttgtctgtaaagtattttatttatccttcacttatgaagcttagcttggctggatatgaaattctgggttgaaaattcttttctttaagaatgttgaatattggcccccactctcttctggcttgtggggtttctgctgagagatccgctgttagtccgatgggcttccctttgtgggtagcctgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccagcttggttccattctccccatcactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctctatcagctcctttaagcacttctctgtattggttattctagttatacattcttctaagttgttttcaaagttttcaacttctttgcctttggtttgaatgtcctcccgtagctcagagtaatttgatcatctaaagccttcttctctcagcttgtcaaagtcattctccatccagctttgttctgttgctggtgaggaactgcgttcctttggaggaggagaggcgctctgcgttttagagtttccagtttttctgttctgttttttcccacctttgtggttttatctactttgggtctttgatgatgatgatgtacagatgggtttttggtgtggatgtcctttctgtttgttagttttccttctaacagacaggaccctcacctgcaggtctgttggagtaccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgacctgtggtgggctccacccagttcgagcttcccagctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagccggtccaaaaagcgcaatatttgggtgggagtgacccgattttccaggtgcgtccgtcacccctttctttgactcggaaagggaactccctgaccccttgcgcttcccaagtgaggcaatgccttgccctgctttggctggcgcacggtgcgcgcacccactgacctgcgcccactgtctggccctccctagtgagatgaacccggtacctcagatggaaatgcagaaatcacccgtcttctgcatcgctcacgctgggagctgtagaccggagctgttcctattcggccatcttggctcctccgcttttt

SEQ ID NO: 12557 - DNA, 6140 bp, Homo sapiens
gtttcttttttgtttattattattattattattatactttaagttatagggtacatgtgcacaatgtgcaggttagttacatatgtatacatgtgccatgctggtgtgttgcacccattaactcatcatttagcattaggtatatctcctaatgctatccctccccactcccctcaccccacaacagtccccagagtgtgatgttccccttcctgtgtccatgtgttctcattgttcaattcccatctatgagtgagaacatgtggtgtttggttttttgtccttgcgatagtttactgagaatgatgatttccaatttcatccatgtccctacaaaggacatgaactcatcattttttatggctgcatagtattccatggtgtatatgtaccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgccttcttttgagaagtgtctgttcatatcctttgcccactttttgatggggttgtttgtttttttcttgtaaatttgtttgagttcattgtagattctgcatattagccctttgtcagatgagtaggttgagaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcttatgtcctgaatggtaatgcctaggttttcttctagggtttttatggttttaggtctaatgtttaagtctttaatccatcttgaattaatttttgtataaggtgtaaggaagggatccagtttcaactttctccatatggctagccagttttcccagcaccatttattaaatagggaatcctttccccattgcttgtttttctcaggtttgtcaaagatcagatagttgtagatatgcggcgttatttctgagggctctgttctgttccactgatctatatctctgttttggtaccagtaccatgctgttttggttactgtagccttgtagtatagtttgaagtcaggtagcgtgatccctccagctttgttcttttggcttaggattgacttggcgatgcgggctcttttttggtgccatatgaactttaaaggagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcaagatttggctgtttgtctgttattggtgtataagaatgcttgtgatttttgtacattgattttgtatcctgagactttgctgaagttgcttatcagcttaaggagattttgggcttagacgatggggttttctagatatataatcatgtcgtctgcaaacagggacaatttgacttcctcttttcctaattgaacaccctttatttccttttcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttaagaaatgtcccatcaatacctaatttattgagagtttttacaatgaagcgttgttgaattttgtcaaaggccttttctgcatctattgagataatcatgtggtttttgactttggttctgtttatatgctggattacatttattgatttgcgtatattgaaccagccttgcatcccagggatgaagcccacttgatcatggtggataagctttttgatgtgctgctggattcggtttgcccgtattttattgaggatttttgcatctatgttcatcaaggatattggtctaaaattctcttttttggttgtgtctctgccctgctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaacttatccatttcttctagattttctagtttatttgcatagaggtgtttgtagtattttctgacggtagtttgaatttctgtgggatcggtggtgatacctcctttatcattttttattgcatctatttgatttttctctctttttttctttattagtcttgctagcggtctatcaattttgttcatcctttcaaaaaaccagctcctggattcattaattttttgatgggttttttttttgtctctatttccttcagttctgctctgattttagttatttcttgccttctgctagcttttgaatgtgtttgctcttgtttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcgttatgtacccagtagtcattcaggagcaggttgttcagtttccatgtagttgagtggttttgagtcattttcttaatcctgaattgtagtttgattgcactgtggtctgagagacagtttgttataatttctgttcttttacattcgctgaggagtgctttacttccaagtatgtggtcaattttggaataggtgtggtgtggtgctgaaaaaaatgtatattctgttgatttggggtggagagttctgtagatgtctattaggtccgcttggtgcagagctgagttcaattcctggatatccttgttaactttctgtctcgttgatctgtctaatgttgacagtggggtgttaaagtctcccattattagtgtgtgggagtctaagtctctttgtaggtcactcaggacttgctttatgaatctgggtgctcctgtattgggtgcatttatatttaggatagttagctcttcttgttgcattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggaacatttagtccatttgtatttaaagttaatattgttatgtgtgaatttgatcctgtcgtcatgatgttagctggttattttgctcattagttgatgtagtttcttcctactctcgatggtctttacattttggcatgattttgcagcaactggtactggttgttcctttccatgtttagtgcttcctttaggagctcttttagggcaggcctggtggtgacaaaatctctcagcatttgcttgtctgtaaagtattttatttctccttcacttatgaagcttagtttggctggatatgaaatgctgggttgcaaattcttttctttaagaatgttgaatattggcccccactctcttctggcttgtagagtttctgctgagagatccgctgttactcggatgggcttccctttgtgggtaacccgaactttctctctggctgctcttaacattttttccttcacttcaactttggtgaatctgacaattatgtgtcttggagttgctcttctcgaggagtatctttgtggcgttctctctatttcctgaatctgaacattggcctgccttgctagattggggaagttctcctggataatatcctgcagagtgttttccaacttggttccattctccccgtcactttcaggtacaccaatcagatgcagatttggtcttttcacatagtcccatatttcttggaggctttgttggtttctttttattcttttttctctaaacttcccttctcgcttcatttcattcatttcctcttccatcactgataccctttcttccagttgagtgcattggctcctgaggcttctgcattcttcacgtagttctcgagccttggctttcagctccatcagctcctttaagcctaaatttttttcaaagttttcaacttctttgcctttggtttgaatttcctcctgtagcttggagtagtttgatcgtctgaagccttcttctctcaactcgtcaaagtcattctccatccagctttgttccattgctggtgaggaactgcgttcctttggaggaggagtggcactctgctttttagagtttccagtttttctgctctgttttttccccatctttgtggttttatctacttttggtctttgatgatggtgatgtactgatgggtttttgatgtggatgtcctttctgtttgttagttttccttctaacagacaggaccctcagctgcaggtctgttggaatttgctaggggtccactccagaccctgtttgcctgggtatcagcagtggtgtctgcagaaccgcggattttcatgatccgcaaatgctgctgtctgatcattcctctggaagttttgtctcagaggagtacccgaccgtgtgaagtgtcagtctgcccctactggggggtgtctctcagtttggctgctcaggggtcaggggtcagggacccacttgaggaggcagtctgcctgttctcagatctccagctgcatgctaggagaaacactgctctcctcaaagctgtcagacagggacatttaagtctgcagaggttactgctgtctttttgtttgtctgtgccctgcccccagaggtggagcctacagaggcaggcaggcctccttgagctgtggtgggctccacccagttccagcttccaggctgctttgtttacctaagcgagcctgggcaatggcgggtgcccctcccccagccttgctgccgccttgcagtttgatctcagactgctgtgctagcaatcagctagactctgtgggcgtaggaccctctgagccatgtgtgggatataatcacctggtgcgccgtttcctaagcctgtcggaaaagcgcagtattcaggtgggagtggcccgatttttcagatgccgtctgtcacccctttccttgaccaggaaagggaactccctgatcccttgcacttcccgagtgagacaatgcctcgccctgctttggctggtgtgaggtgtgctgcacccactgtcctgtgcccactatctggcactccctagtgagatgaacccggtacctcagatagaaatgcagaaatcacccgtcttctgcattgctcacgctgggagctgtagaccggagctgttcctattcggccatcttggctcctccct

SEQ ID NO: 12558 - DNA, 9530 bp, Homo sapiens
tttttttttttttttttttttttgagagagagtctcgctctgtcacccaggctggagtgcagtggcacgatcttggctcactgcaagctccgcctcccgggttcacaccattctcctgcctcagcctcccgagtagctgggactacaggtgcctgccaccacacccggctaattttttttttgtatttttagcagagacggggtttcactgtgttagccaggatggtctcaatctcctgacctcgtgatccgcccgcctcggcctcccaaagtgctgggattacaggcttgagccaccgcgcccggctacgggttcttcttttcaatccttttcaatcctaagaaggacataacatgctgaagtgaaggtatattaggatggttttctctgatttttttttttaatttgatcctaagtatggtatcatgaacgtcacatgttaggatctagcagagtttgaagaattattgtaaacccctgtaaacacagagcaaggtagaaagtgattttcatcgttctcttgctcctcttaccatcctacctgggaaatacactcccattcttatttggactgatttttttcctatgtagtgcagtggccttcattttaaagcctacaattcaacatgatgtttttgggtttagaagttatgttcttgatggtgtgaaagctacatcaaatttcagatttgtcttgtgtaatgtgatacatggacatgcggtcgctggtattggttgcttgtagccaaagaaccataaaaagtacacctaggaatagggcctatggttttgacagtaagtatcgttagagatatagctttccttctaagttggcctactaggttgagattaatgaggaaggtgtgtgtgtgtatacacataccattcactcaatcaattccagtgaaataacacagagaagacaaaaaaagtggccattagggaaaataagtggaccatgggcacagaaaacctcctgttccattcagctgtgctaattagtaatgagcataacattctttttttttttttttaaggccagacggtgtcatttagtaaaataaataaatactcctccctgccatttactaatagtctgaagccttggttgctagttctgcctctatctgttactagtcatatgatcctaggaaattggaaacttctctgagcctcaggtttctgcatctacaaagtggagatagacctaactattgtgttatcttcacctttaaagaatatagtgttcatgaaattgctctgtaaactggacagtggggccttggtgtaaggcattatgttcaggtgtgagttgagattccccgaggtatagagatcttgcattggcacttgagggtcttgaagaagattttcaatttcaatttatgcatgtacccaccggctgtattgacacagcacaaagccaagggcagatttgacaatgatttctttaattttattgatgtgaactgcaaaactgggccattcagtctgcaaagtatctaggctgtaatgatctgacattggctgtctacattcatcaaattaagtggataattagcaaaacaccatttgactttgtgatgtaaagacagtaattgtggctctttctcaattaaaaatctcatccaaagtcatgattttggttgtcacatctgtgcagatgatttccacatttgtttatacctccagctttgaattctttctgaaaagactacattattttcccaacagtcaccaggcattttccctcatgcattttccctccccattattccttcctgggatcttcattttcttatcccaatcagccagtctcaaactctcagggttaactctgactcctctcttccccacacgttccctagtcaatcagctgccaagttctatcaattctatctatgaaacacccttgaaatcttccttctcctctctaattctactgccctgctatcctactacttcatcaaggcccagcctattattacaaaaaccctgtaactggccttccttttccagtattgcctcattccaaccccgtctatatattaatgctctcatcctgctttttctctgctcaaaaatcccctggggtgggattctcactgtctaagaaacaaagcctgaattcttcctcctggtgttctcagcattgcaaggcctggctctaacctgtctttcccactttatcttctcccactccccttcatgtacactactgagtaattcttggtttcctgcacggattcatttcccttttggatgctgtcctatgttcacacatctccctcctctggaaatttcctcctcctcattatagccttcaaaccccactccaagccccacttattcttcaagagccattcaaatgccacctccccactgcgctcctttaggcttctggttggaaagactctctccctaatctgtactccactgcactttaacaacatctgcccaactttctcccctttagactataaattcctttaaggcaggatttgtgccagagtcatctctgtattccccagggtccacatatcctgcatatagtagctgttctttaaatacctgttgaataaatgaatgcttgtaaagaaagcatgcttctaatcatatttttttcttatcttctaatgtgggatgcaacttcttatttgactatgtaaactcatgtggtgaaatattttccttcaaggacacataatatgctcctatggcctccttctctctgataaggttggtcttttaccagtggtttgtagcactaattataggagggaggaaagaaaattctggaaagtagattacagaagaggaaaaacaaacatgagaattctaagtaaaaatggaaaatagcatgtttacaaagaaggacatcttgaaaggcagcattcctctagggcagtgctaattttaagaggaatagaagaaaaagtaatgtatttttctaaaaggagaaactgaacttgtaagaactgtagaataatcaaattattgtgaaattgggccagactttccccagaattctgtagcccattggatttgacaagattagacaagagaggtaaaaatgatggttggactaaagaaaaggactaatggagacaaattataggtatggtcatggtttcaccccaaagatagatgaatggtgtttaaaagaccatcatatcctacagatgggagcttttcttgtccctcccaatctacccagcgcattgaaagagaaaaagagcaaatcgaagcaatgcattttgatgcaaaatatagagacagggatggttaaaactcaagaatagaggcaggatttcatatggatacatttcatagtaatacaataaattaaatatttaaaagtttatttttaggttcaccaaaagagcccaaagtcatcaaaatgtcccatactaagatccttccaagagaattgattagagctttctgacagtataatgtgatggattagtgagttttcctcaatttgttgatgaaaaaacagtgctcaatgtattattttaacatagtagctattaggttaaatgctgttacgaccagtattaattgttaaatattaacaaaggttcagatataatcttgcctaagggcaagaggatgtctcacattttccagaatatctatgactctaagtaagtttactattttcttttttttttaattttattattattatactttaagttttagggtacatgtgcacaatttgcaggttagtttcatatgtatacatgtgccatgctggtgtgctgcacccattaactcgtcatttagcattaggtatatctcctaatgctatccctcccacctcccccaccccacaacagtccccagagtgtgatgttccccttcctgtgtccatgtgatctcattgttcaattcccacctatgagtgagaacatgtggtgtttggttttttgtccttgcgatattttacggagaatgatgatttccaatttcatccatgtccctacaaacaacatgaactcatcatttcttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatataaccagtaatgggatggctgggtcaaatgctatttctagctctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttctttgcctgtgcagaagctctttagtttaattagatcccatttgtcaattttggcttttgttgccattgcttttggtgttttagtcatgaagtacttgcccatgcctatgtcctgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaatagggaatcctttccccatttcttgtttttgtcagggttgtcaaagaacagatagttgtagatatgcagcgttatttctgagggctttgttctgttccattgatctatatgtctgttttggtgccagtaccatgctgttttgtttactgtagccttgtagtatagtttgaagtcaggtagcgtgatgtctccagctttgttcctttggcttaggattgacttggtgatgcgggctcttttttggtaccatatgaactttaaggtagttttttccagttctgtgaagaaagtcattggtagcttgatggggatggcattgaatctataaattaccttgggcagtatggccattttcacgatattgattcttcctacccatgagcatggaatgttcttccatttctttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcaccttaaggagattttgggctgagacgatggggttttctagatatacaatcatgtcgtctgcaagcagggacaatttgacttcctcttttcctaattgaataccctttatttccttctcctgcctaattgccctggccagaacttccaacactatgttgaattggagtggtgagagagggcatccctgtcttgtgccagttttcaaagggagtgcttccagtttttgcccattcagtatgatattggctgtgggtttgtcatagatagctcttattattttgagatacagcccatcaatacctaatttattgagagtttttagcatgaagcgttgttgaattttgtcaaaggccttttctgcatctattgagataatcatgtagtttttgtctttgattctgtttatatgctagattacatttattgatttgtgtatattgaaccagccttgcatcccagggatgaagcccacttgatcatggtggataagctttttgatatgctgctggattcggtttgccagtattttattgaggatttttgcatcaatgttcatcagggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctttggtagaatttggctatgaatccatctggtcctggactctttttcgttggtaagctattgattattgccacaatttgagatcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatgtcctctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctcgattttagttatcttttgccttctgctagcttttgaatgtgtttgctcttgcttttctagttcttttaattgtgatgttagggtgtcaattttagatctttcctgctttctcttgtgggcatttagtgctataaatttccctctacacactactttgaatgtgtcccagagattctggtatgttgtgtctttgttgtcgttggtttcaaagaacatctttatttctgtcttcattttgttatgtacccagtagtcattcaggagcaggttgttcagtttccatgtagttgagcggttttgagtgcgtttcttaatcctgagttctagtttgattgcactgtggtctgagatacactctgttataatctctgttcttttacatttgctgaggagagctttacttccaactatgtggtcaattttgaaataggtgtggtgtggtgctaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagcttttcttgttgaattgatcctgttaccattatgtaatggccttctttgtctcttttgatctttgttggtttaaagtctgttttatcagagactaggattgcaacccctgcctttttttgttttccatttgcttggtagatcttcctccatccttttattttgagcctatttgtgtctctgcacatgagatgggtttcctgaatacagcacactgatgggtcttgactctttatccaatttgccagtctgtgtcttttaattggagcatttagtccatttacatttaaagttaatattgttatgtgtaaattttatcctgtcattatgatgttagctggttgttttgctcattagttgatgcagtttctgcctagcctcgatggtctttacaatttggcatgattttgctgtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggccagatatgaaattctgggttgaaaattcttttctttaagaatgttgaatattggcccccactctcttctggcttgtagagtttctgccaacagatctgctgttagtctgatgggcttccctttgagggtaacccgccctttctctctggctgcccttaacattttttccttcatttcaactttggtgaatctgacaattatgtgtcttggagttgctcttcttgaggagcatctttgtggcgttctctgtatttcctgaatctgaatgttgacctgccttgctagattgtggaagttcttctggataatatcctgaagagtgttttccaacttggttccattctccccgtcactttcaggtacacaaatcagatgtagatttggtcttttcacatagtcccatatttcttggaggctttgtttgtttctttttattcttttttctctaaacttcccttcctgcttcattttattcatttcatcttccatcagcaataccctttcttccagttgatcgcattggctcctgaggcttctgcattcttcacgtagttctcgagccttggctttcagctccgtcagctcctttaagtacttctctgtattggttattctagttatacattcgtctaaatatttttcaaagtttttaacttctttgcctttggtttgaatttcctcccgtagctcagagtagtttgatcgtctgaagacttctctcaactcatcaaagtcattctccctccagctttgttccgttgcttgtgaggaactgcgttcctttggaggaggagaggtgctctgctttttagagttcccagtttttctgctctgttttttccccatctttgtggttatatctacttttggtctttgatgatggtgatgtacagatgggtttttggtgtggatatcctttctgtttgttagttttccttctaacagacaggaccctcagctgcaggtctgttagagtttgctagaagtccactccaggccctgtttgcctgggtatcagcagcggtggctgcagaacagcggattttcgtgaacctcgaatgctgctgtctgattgttcctctggaagttttgtctcagaggagtacctggccgtgtgaggtgtcagtctgcccctacttgggggtgcctcccagttaggctgctcgggggtcaggggtcagggacccacttgaggaggcagtctgccctttctcagatctccagctgcgtgctgggagaaccactgctctcttcaaagctgtcagacagggacatttaagtctgcagaggttactgctgtctttttgtttgtctgtgcccttccctcaaaggtggagcctaccaaggcaggcagccctccttgagctgtggtgggctccacccagttcgagcttgccggctgctttgtttgcctaagcaagcctgggcaatggcgggtgcccctcccccagcctcgctgctgccttgcagtttgacctcagactgtgtgctagcaatcagtgagactctgtgggtgtaggaccctctgagccaggtgcaggatatagtctcttggtgcaccattttttaagcccgtagg

SEQ ID NO: 12559 - DNA, 6067 bp, Homo sapiens
tttttattttattttatttatttatttatttatttatttatttttttattatactttaagttttagggtacatgcgcacattgtgcaggttagttacatatgtatacatgtgccatgctggtgcgctgcacccactaactcgttatctagcattaggtatatctcccaatgctatccctcccccctccccctaccctaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttgttatggctgcatagtattccatggtgtatatgtgccacattttcttaatccggtctatcattgttggacatttgggttggttccaagtctttgctattgtgaataatgccgcaataaacatacgtgtgcatgtgtctttatagcagcatgatttatagtgctttgggtatatacccagtaatgggatggctgggtcaaatggtatttctagttctagatccctgaggaatcgccacactgacttccacaatggttgaactagtttacagtcccatcaacagtgtaaaagtgttcctgtttctccacatcctctccagcacctgctgtttcctgactttttaatgattgccattctaactggtgtgagatggtatctcattgtggttttgacttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgggtattagccctttgtcagatgagtaggttgcaaaaattttctccaattttgtaggttgcctgttgactctgatggtagtttcttttgctgtgcagaagctctttagtttaattagattccatttgtcaattttgtcttttgttgccattgcttttggtgttttggacatgaagtctttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcagatttgtcaaagatcagatagttgtagatatgaggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagctttatggggatagcattgaatctgtaaattaccttgggcagtatggccattttcacgatattgattcttcctacccatgagcatggaatgttcttccatttgtttgtatcctcttttatttcctcgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaatgcttgtgattttggtacattgattttgtatcctgagactttgctgaagttgcttatcagcttaaggagattttgggctgagacaatggggttttctagatatacaatcatgtcatctgcaaacacggacaatttgacttcctcttttcctaattggataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttcttgagagtttttagcatgaagggttgttgaattctgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaatcctcttttttggttgtgtctctgcccggctttggtatcagaatgacactggcctcataaaatgagttagggaggattccctctttttctattgattggaatagtttcagaaggaatggtaccagttcttccttgtacctctggtagaattcggctgtgaatccatctggtcctggactcttttttgttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttcattgtgatgttagggtgtcaattttggatctttcctgctttctcttgtgggcatttagtgctataaatttccctctacacactgctttgaatgcgtcccagagattctggtatgttgtttctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgctataatctctgttcttttacatttgctgaggagagctttacttccaagtatgtggtcaattttggaataggtgtggtgtgatgctgaaaaaaatgtatattctgttgatttcgggtggagagttctgtagatgtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgacgttagctggtgattttgctcgttagttgatgcagtttcttcctagtctcgatggtctttacattttggcatgattttgcagcagctggtactggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcacccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccgatcagacgtagatttggtcttttcacatagtcccatatttcttggaggctttgctcatttctttttattcttttttctctaaacttcccttctcgcttcatttcattcatttcatcttccgtcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctgtggtttgaatgtcctcccgtagctcagagtaattcgatcgtctgaagccttcttctctcagcttgtcaaagtcattctccatccacctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgctgtgtgaggtgtcagtgtgcccctgctggggggtgcctcccagttaggctgctgaggggtcagggacccacttgaggaggcagtctgcccgttttcagatctccagctgcgtgctgggagaaccactgctctctacaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagcaatcagcgagactccgtgggcgtaggaccctcccagccaggtgcgggatataatctcgtggtgcgccgttttttaagccggtccgaaaagcgcaatattcaggtgggagtgacccaattatccaggtgcgtccgtcacccctttctttgactcggaaagggaactccctgaccccttgcgcttcccaagtgaggcaatgcctcgccctgcttcggcttgcgcacggtgcgcgcacccactgacctgcgcccactgtctggcactccctagtgagatgaacccggtacctcagatggaaatgcagaaatcacccatcttctgcgtcgctcacgctgggagctgtatactggagctgttcctattcggccatcttggctcctccccccataattt

SEQ ID NO: 12560 - DNA, 4840 bp, Homo sapiens
atttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctc

SEQ ID NO: 12561 - DNA, 5008 bp, Homo sapiens
tatatatatatatatatatatatatatatatattatactttaagtcctagggtacatgtgcacaacatgcaggtttgttacatatctatacatgtgccatgttggtgtgctgcacccattaactcaaaatttactttaggtatatctcctaatgctatcactcccccctccccccaccccacaacaggccccggtgtgtgatgttccacttcctgtgtccaagtgttctcattgtttaattcccacctatgagtgagaacatgtggtgtttggttttttcgtccttgtgatagtttgctgaggatgatggtttccagcttcatccatgtccctacaaaggacatgaactcatcattttttatggctgcatagtattccacggtgtatatgtgccacattttcttaatccagtctatcattgttggacatttgggttggttccaagtctttgctattgtgaatagtgccgcaataaacatatgtgtgcatgtgtctttatagcagcatgatttataatcctttgggtatatacccagtaatgggattgctgggtcaaatggtatttctagttctagatccctgaggaatcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcactgtgcttttgatttgcacttctctgatggccagtgatgatgagcattttttcatgtgtcttttggctgcataaatgttttcttttgagaagcatctgttcatatcctttgcccacttattgatggggttgtttgtttttttcttgtaaatttgtttgagttctttgcagattctggatattagccccttgtcagatgagtagattgcaaaaattttctcccattttgtaggttgcctgttcactctgatggtagcttcttttgctatgcagaagctctttagtttagttagatcccatttgtcaattttggcttttgttgccattgcttttggtgttttagacatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagtcagttttcccagcatcatttgttaaatagggaatgctttccccatttcttgtttttgtcaggtttgtcaaagatcagatagttgtagatgtgtggtattatttctgagggctctgttctgttccattggtctatatctctgttttggtaccagtaccatgctgttttggttactgtagccttgtagaatagtttgaagtcaggtagcgtgatgcctccagctttgttcttttggcttaggattgacttggcaatgcaggctctttttttgttccttataaactttaaagtagttttttccagttctgtgaagaaagtcattggtagcttgatggggatggcattgaatctataaattaccttgggcagtatggccattttcacaatattgattcttcctatccatgagcatggaatgttcttccatttgtttgtgtcctcttttatttcgttgagcagtggtttgtagttctccttgaagaggtccttcacatcccttgtaagttggattcttaggtattttactctctttgaagcaattgtgaatgggagttcactcatgatttggctctctgtttgtctgttattggtgtataagaatgcttgtgatttttgcacattgattttgtatcctgagactttgctgaagttgcttatcaatcagcttaaggaaattttgggctgatatgatggggttttctagatatacaatcatttcatctgcaaacagggacaatttgacttcctcttttcctaattgaataccctttatttctttctcctgcctgattgccttggccagaacttccaacactgtgttgaatacgagtggtgagagagggcatccctgtcttgtgccacttttcaaagggaatgcttccagtttttgcccattcagtatgatattggctgtgggtttgtcataaatagctcttactattttgagatacgtcccatcaatacctaatttattgagagtttttagcatgaagggctgttgaattttgtcaaaggccttttctgcatctattgagataatcacgtggtttttgtctttggttctgtttatatgctggattacatttattgatttgctatgttgaaccagccttccatcccagggatgaagcccacttgatcatggtggataagctttttgatgtgctactggattcgctttgccagtattttattgaggattttcgcatcgatgttcatcagggatactggtctaaaattctctttttttgttgcgtctctgccaggcttcggtgtcaggatgatgctggcctcataaaatgagttagggaggattccctctttttctatatgattggaatagtttcagaaggaatggtaccagctccttcttgtacctctggtagaatttggctgtgaatccgtctggtcctggactttttttggttggtaagctattaattattgcctcaatttcagagcctgttattggtctattcagagattcaacttcctcccggtttagtcgtgggaggttgtatgtgtcgaggaatttatccatttcttctagattttctagtttatttgtgtaaaggtgtttatagtactctctgatggtagtttgtatttctgtgggatcggtggtgatatcccctttatcattttttattgcgtctatttgattcttctctcttttcttatttattagtcttgctagcagtctatcaattttgttgatcttttcaaaaaaccagctcctggattcattgattttttgaaggttttttttgtgtctctatctccttcagttctgctctgatcttagttatttcttgccttctgctagcttttgaatgtgtttgctcttgcttctctcgttcttttaattgtgatgttagggtgttaattttagatctttcctgctttctcttatgggcatttagtgctataaatttccctctacacactgctttaaatgtgtcccagagattctggtatgttgtgcctttgttctcgttggtttcaaagagcatctttacttctgccttcatttcattatgtacccagtagtcattcaggagcaggttgttcagtttccatgtagttgagtggttttgagtgagtttcttaattctgagttcttctatgattgcactgtggtctgagaggcagtttgttataatttctgttcttttacatttgctgaagagtgctttacttccaactatgtggtcagttttggaataagtgctatttggtgctgagaagaatgtatattctgttgatttggggtggagagttctgtagatgtctattaggtccacttggtgcagagctgagttcaattcctggatatgcttgttaactttctgtctcatggatcagcctaatgttgacagtggggtgttaaagtctcccattattattgtgtgggagtctaagtctctttgtaggtcactcaggacttgccttatgaatctgggtgctcttgtattggatgcatatatatttaggatagttagctcttcttgttgaattgatccctttactgttatgtaatggccttctttgtctcttttgatctttgttggtttaaagtctgttttatcagagactaggattgcaacccctgccttttgttgttttcctttgcttggtggatcttcctccatccctttattttgagcctatgtgtgtctctacacgtgagatgggtctcctgaatacagcacactgatgggtcttgactctttatccaatatgccagtttgtgtcttttaataggagcatttagcccacttacatttaaggttaatattgttatgtgtgaatttgatcctgtcattttgatgttagctggttattttgcttgttagttgatgcagtttcttcctagcatcaatggtctttacaatttggcatgtttttgcagtggctggtaccggttgttcctttccatgtttagtgcttccttcaggagctcttgtagggcaggcctggtggtgacaaaatctctcagcatttgcttgtctgtaaaggatttgatttctccttcacttatgaagcttagtttggctggatatgaaattctggattgaaaattcttttctttaagaatgttgaatattggcccccactctcttctggcttgtagaatttctgctgagagatcagctgttagtctgattggcttccctttgtgggtaacccaacctttttctctggctgcccttaacattttttccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccaacttagttccattctcctcgtcactttcaggtacaccaatcagatgtagatttggtcttttcacatagtcccatatttcttggaggctttgttcatttctttttattcttttttctctaaacttctcttctcacttcatttcattcatttgatcttcaatcactgataccctttcttccagctgaccaaattggctactgaagcttgtgcattcgtcacatagttctcctgccatggttttcagctccatcaggtcatttaaggccttctctacattggtaattctagttagccattcgtctaatcttttttcaaggtttttaacttctttgcgatggctcgaacttcctcctttagctcggagaagtttgtccatctga

SEQ ID NO: 12562 - DNA, 6045 bp, Homo sapiens
ataaatttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaactgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccaccttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccaggtttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgctggttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctatggagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcattaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggttcagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattgtggatctttcctgctttctcttgtaggcatttagtgctataaatttccctctacacactgctttgaatgcatcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattatgtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgagaacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcgcactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgtcctttctctctggctgcccttaacattttttccttcatttcaactttggtgaatctgacaattatgtgtcttggagttgctcttctcgaggaatatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaattttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccaatttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatatcctgccgtgtgaggtgtcagtgtgcccctgctggggggtgcctcccagttaggctgctcaggggtcaggagtcagggacccacttgaggaggcagtctgcccgttctcagatctccagctgcgtgctgggagaaccactgctctcttcaaagctgtcagacagggacagttaagtctgcagaggttactgctgtctttttgtttgtctgtgccctgcccccagaggtggagcctacagaggcaggcaggcctccttgagctgtggtgggctccacccagttcgagcttccgggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccatttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgtgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccta

SEQ ID NO: 12563 - DNA, 10422 bp, Homo sapiens
ttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttt

SEQ ID NO: 12564 - DNA, 5928 bp, Homo sapiens
ttatcctatctttctttttttaatttaattttattttattattattatactttaagttttagggtacatgtgcataatgtgcaggttagttacatatgtatacatgtgccatgttggtgtactgcactcattaacttgtcatttaacattaggtatatctcctaatgctatccctcccctctccccccaccccacaacagtccccggagttcgatgttccccttcctgtgtccatgtgttctcattgttcaattcccacctatcagtgagaacatgcggtgtttggttttttgtccttgcgatagcttgctgagaatgatgatttccagtttcatccatgtccctacaaaggacatgaactcatcattttttatggctgcatagtattccatggtgtatatgtgccacattttcttaatccagtctatcattgatggacatttgggttggttccaagtctttgcttttgtgaatagtgccgcaataaacatacgtgtgcatgtgtctttatagcagcatgatttatagtcctttgggtatatacccagtaatgggatggctgggtcaaatggtatttccagttctagatccctgaggaatcgccacactgacttccacaagggttgaactagtttacagtcacaccaacagtgtaaaagtgttcttgtttctccacatcctctccagcacctgttgtttcctgactttttaatgatcaccattctaactggtgtgagatggcatcttattgtggttttgatttgcatttctctgatggccagtgatgatgagcactttttcatgtgttttttggctacataaatgtcttcttttgagaagtgtctattcatatccttcgcccactttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtccattttggcttttgttgccattgcttttggtgttttagacatgaagtccttgcccatgcctatgtcctgaatggtattgcctaggttttcttctagggttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcgggtttgtcaaagatcagatagttgtagatatgcggcattatttctgagggctctgttctgttccattgatctatatctctgttttggtaccagtaccatgctgttttggttaccgtagccttgtagtatagttagaagtcaggtagtgtgatgcctccggctttgttcttttggcttaggattgacttggcaatgcgggctcttttttggttccatatgaactttaaagtagttttttccaattctgtgaagaaagtcatttgtagcttgatggggatggcattgaatatataaattaccttgggcagtatggccattttcacgatattgattcttccaacccatgagcatggaatgttcttccatttgtttgtatcctcttttatttcattgagcagtggtttgtagttctctttgaagaggtccttcacgtcccttgtaagttggattcctacccattttattctctttgaagcaattgtgaatgggagttcactcatgatttgactctctgtttgtctgttattggtgtataacaatgcttgtgatttttgtacattgattttgtaccctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcgttatgatattggctgtgggtttgtcatagatagctcttattattttgagatatgtcccatcaatacctaatttattgagagtttttagcatgaagcattgttgaattttgtcaagggccttttctgcatctattgagataatcatgtggtttttgtctttggttctgtttatatgctggattaccgttattgatttgcatatgttgaaccagccttgcattccagggatgaagcccacttgatcatggtggataagctttttgatgtgctgctggatttggtttgccagtattttattgaggatttttgcatcaatgttcatcaaggatattggtctaaaattctcttttttggttgtgtctctgccaggctttggtatcaggatgacgctggcctcataaaatgagttagggaggattccctctttttctgttgattgtaatagtttcagaaggaatggtaccagctcctccttgtacctctggtagaatttggctgtgaatccatctcgtcctggactctttttggttgataagctattgattattgccacaatttcagagcctgttattggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttatttattagtcttgctagcggtctatcaattttgttgatcttttcaaaaaaccagctcctggattcattaatttttttgaagggttttttgtgtctctgtttccttcaattctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttattctcattggtttcaaagaacatctttatttctgccttcatttcattatgtacccagtagtcattcaggagctggttgttcagtttccatgtagttgagcagttttgagtgagtttcttaatcctgagttctagtttgattgcactgtggtctgagagacagtttgttataatttctgttcttttacatcttctgaggagtgctttacttccaactgtgtggtcagttttggaataggtctggtgtggtgccgaaaaaaatgtatattctgttgatttggggtggagagttctgtagatgtctattaggtctgcttggtgcagagctgagttcaattcctgggtatccttgttaactttctgtctcgttgatttgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgttggtttaaattctgttttatcagagactaggattgcaacccctaccattttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtggataacccgacctttctctctggctgcccttaacattttttccttcatttcaactttggtgaatctgacaattatatgtcttggagttgcttttctcgaggagtatctttgtggtgttctctgtatttcctgaatctgaatgttggcctgccttgctagattggggaagttctcctggataatatcctgcagagtgttttctaacttcgttccattctccccgtcactttcaggtacaccaatcagacgtagatttggtcttttcacatagtcccatatttcttggagactttgttcatttctttttattcttctttctctaaacttcccttctcgcttcatttcattcatttcatcttccgtcactgataccctttcttccagttgatcgcattggctcctgaggcttctgcattcttcacgtagttctcgagccttggctttcagctccatcagctcctttaagcatttctctgtattggttattctagttatacattcatctaattttttttcaaagtttttaacttctttgccattggtttgaatttcctcctgtagctcagagtagtttgatcatctgaagccttcttctctcaactcatcaaagccattctccgtccagctttgttccgttgctggtgaggaactgcattcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacagacaggaccctcagttgcaggtctgttggagtttgctagaggtccactccagaccgtttgcctgggtatcagcagcggtggctgcagtacagcggtggctgtagaacagcggattttcgtgaaccgcaaatgctgctgcctgatcggtcctctggaagttttgtctcagaggagtacctggctgtgtgaggtgtcagtctgcccctacttgggggtgcctcccagttaggctgctcgggggtcagggacccacttgaggaggcagtctgcctgttctcagatctccagctgcgtgctgggagaaccactactctcttcaaagctgtcagacaggaacgtttaagtctgcagaggttactgctgtctttttgtttgtctgtgccctgcccccagaggtggagcctacagaggcaggcaggcctccttgagctgtggtgggccccacccagttcgagcttcccggctgctttgtttacctaagcaagcctgggcaatggcaggcgcccctcccccagccttgctgccaccttgcagtttgatctcagactgctgtgctagcaatcagcgagactccgtgggcataggacccgccgagccatgtgcagaatataatctcctgttgtgctgttttttaagcctgttggaaaagcgcagtattagggtgggagtgaccc

SEQ ID NO: 12565 - DNA, 7194 bp, Homo sapiens
atgcttttttcctgaaaattttcttttttttttttaattatactttaagttttagggtacatgtgcacattgtgcaggttagttacatacgtatacgtgtgccatgctggtgcactgcacccactaactcgtcatctagcattaggtatatctcccaatgctatacctcccccctccccccaccccacaacagtctccagtgtgatattccccttcctgtgtccatctgttctcattgttcaattcccacctatgagtgagaatatgcggtgtttggttttttgttcttgcaatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttcatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctatgcagaagctctttaatttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgtttggtgtataagaatgcttgtgatttttatacattgattttgtatcctgagactttgctgaagttgcttatcagcttaaggagattttgggctgagacaacggggttttctagatatacaatcatgtcgtctgcaaacagggacaatttgacttcctcttttcctaattgaataccctgtatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcctatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtctgccagtattttattgaggatttttgcatcaatgttcatcaaggatattggtctaaaatcctctttttttgttgtgtctctgcctggctttggtatcagaatgatgttggcctcataaaatgagttagggacgattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcgtgggagagtgtatgtgtcgaggaatttatccatttcttctagattttctagtttatttgcgtagaggtgtttgtactattctctgatcgtagtttgtatttctgtgggatcggtggtgatatcccctttatcattttttattgcgtctattagattcttctctttttttctttattagtcttgctagcggtctatcagttttgttgatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtggacatttagtgctataaatttccctctacacactgctttgaatgcgtcccagagattctggtatgttgtgtctttgttctcattggtttcaaagaacatctttatttctgccttcatttcgttatgtacccagtagtcattcaggaacaggttgttcagtttccatgcagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttacgatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgagtctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccaacctttctctctggctgcccttaacattttttccttcatttcaactttggtgaatctgacaattatgcgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaattgttttcaaagttttcaacttctttgcctttggtttgaatgtcctcccgtagctcagagtaatttgatcatctgaagccttcttctctcagctcgtcaaagtcattctccatccagctttgttcagttgctggtgaggaactgcgttcctttggaggaggagaggcactctgcattttagggtttccagtttttctgttctgttttttccccatctttgtggttttatctacttttggtctttgatgatggtgatgtacagatgggtttttggtgtggatgtcctttctgtttattagttttccttctaacagacaggaccctcagctgcaggtctgttggaataccctgccgtgtgaggtgtcagtgtgcccctgctggggggtgcctcccagttagactgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtgccctgcccccagaggtggagcctacagaggcaggcaggcctccttgacctgtggtgggctccacccagttcgagcttcccagctgctttgtttacctaatcaagcctgggcaatggcgggcgcccctcccccagcctcgctgccgccttgcagtttgatctcagactgctgtgctagcaatcagcgagattccgtgggcgtaggaccctccgagccaggtgcgggatatagtctcctggtgcgccgttttttaagcccgtcggaaaagcgcagtattcgggtgggagtgacccgattttccaggtgccgtccgtcacccctttctttgactcggaaagggaactccctgaccccttgcgcttcccaagtgaggcaatgcctcgccctgcttcggctcgcgcacggtgcgtgcacccactgacctgcgcccactgtctggcgctccctagtgagatgaacccggtacctcagatggaaatgcagaaatcaccgtcttctgcgtcgctcacgctgggagctgtagaccggagctgttcctattcggccatcttggctcctccaggaaggtcagattctaactaatttccatggactgttatgtaagaacacaggaattagatttttaatacttaggttggaattcaggcattcagtcaaatgcaatgtggagttacttcagagaggctatctgcctggcttctgcaggagtccaccaccttaatattgcccaacagctcataatagcaaaatggtggatatagatggtgttccagaaaaggaattcatcaccaagtctaaagaacatggaaataatcttactgttttcatgagctggtactaaagatgtcagacgtctcaagttctttgtgataagaacttgcaaaatcgtttttttcattagaagtcacatgaagtagattcattctagacctttatttactactcccttaaccagtgtaattgcagggtaatggcagcaactgtcttagtcagtggagtctattccttgagagggctggatgccctagagataaatccaaattatctctggttatagttgccctgaaatgaaccttctttcccaaaggaaaactattatctgtatctcttgggctgggctaggatggagaggctttgagagcattgcttgcaccggcatctttgctgatagtctgacaatgtttaaggcaggtgtttgtggcatttggccaacaccaaagtgaaatttagttgaagattcagtaagtaagtggatgactaattttgctgtgcctcaatgttcgcctgttgttgcctgttcaataattcttggttattgagctgcctctaagcagtaatttagttaaggctgtgtggatatctggaggactgtctcctctagaaattgggatgtgatttgggagtatcaccaggggttgcctgagaggcgcagcctgcagcttcgccctcttggctaagagccccttcacttttgctggcaacatgcccccctcttgctggatgggctatcttcctttcgtgttgaaggacacacctttgaaaatttgttgcctcagtaaaagatgttggggcagtggttctcaaccctggctgcacattaaagtaacttgagctttaaaaaaaaactcatgtctgggctcctccttaaaccaatttaatgagttgagggtggagcctgggcatcagtatattaagtctcttaggagaag

SEQ ID NO: 12566 - DNA, 6066 bp, Homo sapiens
ctttttttttaaaattttttttattatactttaataaatgtgtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccttgaggaatcgcaacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgataatgagcattttttcatgtgttttttggctgcacaaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcctttggtgttttagacatgaagtccttgcccatacctatatcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttcccccttgcttgtttttctcaggtttgtcaaagatcagatagttgtagatatgcggcgttatttctgagggctctgttctgttccattgatctatatctctgttttggtaccagtagcatgctgtttgggttactgtggccttgtagtatagtttgaagtcaggtagtgtgatgcctccagctttgttcttttggcttaggattgacttggtgatgcgggctcttttttggttccatatgaactttaaagtagttttttccaattctgtgaacaaagtcattggtagcttgatggggatggcattgaatctgtaaattaccttgggcagtatggccattttcacgatattgattcttcctacccatgagcatggaatgttcttccatttgtttgtttcctcttttatttcactgagctgtggtttgtagttctccttgaagaggttcttcacatcccttgtaagttggattcctaggtattttattctctttgaagcaattgtgaatgtgagttcactcatgatttagctctctgtttgtctgttgttggtgtataagaatgcttgtgagttttgtacattgattttgtatcctgagactttgctgaagttgcttatcagcttaaggagattttgggctgagacaatggggttttctagatatacaatcatgtcatctgcaaacggacaatttgacttcctcttttcctaattgaataccctttatttccttctcttgcctaattgccctggtcagaacttccaacactatgttgaataggagtggtgagagagggcatccctgtcttgtgccagttttcaaagggaatgcttctagtttttgcccattcagtatgatattggctgtgggtttgtcatagatagctcttattattttgaaatacatcccatcgatacctaatttattgagagtttttagcatgaagggttgttgaattttgtcaaaggccttttctgcatctattgagataatcatgtggtttttgtctttggctctctttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaagctattgattattgcctcaatttcagctcctgttattggtctattcagagattcaacttcttcctggtttagtcttgggagagtgtatgtgtcgaggaatgtatccatttcttctagattttctagtttatttgtgtagaggtgtttgtagtattccctgatggtagtttgtatttctgtgggatcggtggtgatatcccctttatcattttgtattgcgtctatttgattcttctctctttttttctttattagttcttgctagcggtctatcaattttgttgatcctttcaacaaaccagctcctggattcattaattttttcaagggttttttgtgtctctatttccttgagttctgctctgattttagttatttcttgccttctgctagcttttgaatgtgtttgctgttgcttttctagttcttttaattgtgatgttagggtgtcaattttggatctttcctgctttctcttgtgggcattcagtgctatacatttccctctacacactgctttgaatgcgtcccagagattctggtatgttgtgtctgtgttctcgttggtttcaaagaacatctttatttctgccttcatttcattatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaagagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagacgaggattgcaacccctgcctttttttgttttccattggcttggtagatctccctccatccttttattttgagcctatgtgtgtctctgcacgtgagatgggtttcctgaatacagcacactgatgggtcttgactctttctgtgtctttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgccaggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagtctgtgtcttttaattggagcatttagtccatttacatttaaagttaatattgttatgtgtgaatttgatcctgtcattatgatgttagctggttgttttgctcgttagttgatgcagtttcttcctagcctcgatggtctttacattttggcatgattttgcgcggctggtaccagttgttcctttccatgtttagtgcttccttcaggagctcttgtaaggcaggcctggtggtgacaaaatctctcagcatttgcttgtctttaaagtattttatttctccttcgcttatgaagcttagtttggctggatatgaaattctgggttgaaaattcttttctttaagaatgttgaatattggcccccactctcttctggcttgtagggtttctgccgagagatctgctgtttagtctgatgcgcttccctttgagggtaacccgacctttctctctggctgccctttacattttttccttcatttcaactttggtgaatctgacaattatgtgtcttggagttgctcttctcgaggagtatctttgtggcgttctctgtatttcctgaatctgaacgttggcctgccttgctagatgggggaagttctcctggataatatcctgcagagtgttttccaacttggttccattctccccatcactttcaggtacaccaatgagacgtagatttggtcttttcacatagtcccatacttcttggaggctttgctcatttctttttattcttttttctctaaacttcccttctcgcttcatttcattcatttcatcttccatcgctgataccctttcttctagttgatcgcatcggctcctgaggcttctgcattcttcacgtagttcttgagccttggttttcagctccatcagctcctttaagcacttctctgtattggttattctagttatacattcttctaaatttttttcaaagatttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgtttttcccccatctttgtggttttatctacttttggtctttgatgatggtgatgtacagatgggtttttggtgtggatgtcctttctgtttgttagttttccttctagcagagaggaccctcagctgcaggtatgttggagtactctgccatttgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactactgtctttttgtttgtctgtgccctgcccccagaggtggagcctacagaggtaggcaggcctccttgagctgtggtgggctccacccagttcgaccttcctggctgctttgtttacctaatcaagtctgggcaatggcgggcgcccctcccccagcctcgctgccgccttgcagtttgatctcagacagctgtgctagcaatcagcgagactccgtgggcgtaggaccctctgagccacgtgcgggatataatctcatggtgcgccattttttaagcccattggaaaagcgcagt

SEQ ID NO: 12567 - DNA, 6071 bp, Homo sapiens
tttattttttttttttttatttttttttttttattttttattttttattatactttaagttttagggtacatgtgcacattgtgcaggttagttacatatgtatacatgtgccatgctggtgcgctgcacccaccaacgtgtcatctatcattaggtatatctcccactgctatccctcccccctcccccgaccccaccaccgtccccagagtgtgatattccccttcctgtgtccttgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagatagttgtagatacgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttctggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcagtcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgagtctatttgattcttctctctttttttctttattagtcttgctagcggtctatcaattttgttgatcctttcaagaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgcatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtgtaagtctctttgtaggtcactgaggacttgctttatgaatctgggtgctcctgtgttgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgggtttcctgaatacagcacactgatgggtcttgactctttatccaacttgccagtctgtgtcttttaattgcagaatttagtccatttatatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtgttgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttgtctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacgtggttccattctccacatcactttcaggtacaccagtcagacgtagatttggtcttttcacatagtcccatatttcttggaggctttgctcatttctttttattcttttttctctaaacttcccttctcgcttcatttcattcatttcatcttccattgctgataccctttcttccagttgatcccatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacaggtgggttttctgttagatgtcctttctggttgttagttttccttctaagagacaggaccctcagctgcaggtctgttggaataccctgccgtgtgaggtgtcagtgtgcccctgctggggggtgtctcccagttaggctgctcgggggtcaggggtcaaggacccaatagaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgccagcaatcagcgagattccgtgggcgtaggaccctctgagccaggtgtgggatatagtctcctggtgcgccgttttttaagccggtctgaaaagcgcaatattcgggtgggagtgacccgattttccaggtgcgtctgtcacccctttctttgactcggaaagggaactccctgacccttgcgcttcccaggtgaggcaatgcctcgccctgcttcggctcgcgcacggtgcgcgcacacactggcctgtgcccactgtctggctctccctagtgagatgagcccggtacctcagatggaaatgcagaaatcacccgtcttctgcgtcgctcacgctgggagctgtagaccggagctgttcctattcggccatcttggctcctccctcgtcacaag

SEQ ID NO: 12568 - DNA, 6100 bp, Homo sapiens
tttgcttctttttctttttttttttttacactttactgcaataattttcatttttttgtttgttttttttaaatgtattattattatactttaagttttagggtacgtgtgcacaatgtgcaggttagttacatatgtatacatgtgccatgctggtgcgctgcacccactaactcgtcatctagcattaggtatatctcccaatgccgtccctcccccctccccccaccccacaacagtccccagagtgtgatgttccccttcctgtgtccatgtgttctcattgttcaattcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggcgtttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagatggtatctcatagtggttttgatttgcatttctctgatggccagtgatggtgagcattttttcatgtgttttttcggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctattcactctgatggtagtttcttttgctgtacagaagctctttagtttaattagatcccatttgtcaattttggcttttgttgccattgcttttggtgttttagacatgaagtccttgcccatgcctatgtcctgaatggtaatgcctaggttttcttttagggtttttatggttttaggtctaacgtttaagtctttaatccatcttgaattgatttttgtataaggtgtaaggaagggatccagtttcagctttctacatattgctagccaggtttcccagcaccatttattaaatagggaatcctttccccattgcttgtgtttctcaggtttgtcaaagatcagatagttgtagatatgcggcattatttctgagggctctgttctgttccgttgatctatatctctgttttggtaccagtaccatgctgttttggttactgtagccttgtagtatagtttgaagtcaagtagcgtgatgcctccagctttgttcttttggcttaggattgacttggtgatgcgggctcttttttggttccatatgaactttaaagtagttttttccaattctgtgaagaaagtcattggtggcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttttactttgattttgtatcctgagactttgctgaagttgcttatcagcttaaggagattttgggctgagacaatggggtttcctagatctacagtcatgttgtctgcaaacagggacaatttgacttcctcttttcctaattgaatactctttatttccttctcctgcctaattgccctggccagaacttccaacactatgttgaatgggagtggtgagagagggcatccctgtcttgtgccagttttcaaagggagtgcttccagtttttgcccattcagtatgatattggctgtgggtttgtcatagatagcttttattattttgaaatatgtcccatccatacttaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattctgtttgccagtattttattgaggatttttgcatcaatattcatcaaggatattggtctacaattctcttttttggttgtgtctctgcctgagtttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtctcgaggaatttatccatttcttctagattttctagtttatttgcatagaggtgtttatagtattctctgatggtagtttgtatttctgtgggatcggtggtgatatcccctttatcattttttattgcgtctatttgattcttctctctttttttctttcttagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatctccctctacacactgctttgaatgcgtcccagagattctggtatgttgtgtctttgttctccttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtatggtgctgaaataaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctatattgggtgcatatatatttaagacaattagctcttcttgttgaattgatccctttaccattatgtaatggccttctttgtctcttttgatctttgttggtttaaagtctgttttatcagagactaggattgcaacccctgcctttttttgttttccatttgcttggtagatctgcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcagctggtaccggttgttcctttccatgtttagcacttccttcaggagctcttttagggcaggcctggtggtgacaaaatctctcagcatttgcttgtctgtaaagtactttatttctccttcacttatgaagcttagtttggctggatatgaaattctgggttgacaattcttttctttaagaatgttgaatattggcccccactctcttctggcttgcggagtttctgccgagagatccgctgttagtctgatgggcttccctttgagggtaacccgacctttctctctggctgcccttaacattttttcctgcatttcaactttggtgaatctgacaattatgtgtcttggagttgctcttctcgaggagtatctttgtggtgttctctgtatttcctgaatctgaacgttggcctgccttgctagattggggatgttctcctggataatatcctgcagagtgttttccaacttggttccattctccccatcactttcaggtacaccaatcagacgtagatttggtcttttcacatagttccatatttcttggaggctttgctcttttctttttattgttttttctctaaacttcccttctcgcttcatttcattcatttcatcttctatcactgataccctttcttccagttgatcgcatcggctcctgaggcttctgcattcttcatgtagttctcgagccttggttttcagctccatcagctcctttaagcacttctctgtattgattattctagttatacattcttctaaatttttttcgaagttttcaacttctttgcctttggtttgaatgtcctcccgtagctcagagtaatttgatcgtctgaagccttcttctctcagctcatcaaagtcattctcaatccagctttgttcccttgctggggaggaactgtgttcctttggaggaggagaggcgctctgctttttagagtttccagtttttctgctctgttttttccccatctttgtgattttatctacttttggtctttgatgatggtgacgtacagatgggtttttggtgtggatgtcctttctgtttgttagttttccttctaacagacaggaccctcagctgcaggtctgttggagtactcggctgtgtgaggtgtcagtctgcccctgttggagggtgcctcccagataggctgctcgggggtcaggggtcagggaaccagttgaagaggaagtctgcccgttctcagatctccagctgcatgctgggagaaccactgctctcttcaaagctgtcagacagggacatttaattctgcagaggttactgctgtctttttgtttgtctgtgccctgccccaagaagtggagcctacagaggcaggcaggcctccttgagctgtggtgggctccacccagttcgagcttcccggctgctttgtttacctaagcaagcctgggcaatggcgggcgcccctcccccggccttgctgctgccttgcagtttgatctcagactgctgtgctagcaatcagcaagactccgcgggcataggaccctccgagccaggtgcgggatataatctcctggtgcgccattttttaagcccgtcggaaaagcgcaatattcgggtgggagtgacccaattttccaggtgccatctgtcacccctttctttgactaggaaagggaactccctgaccccttgcgcttcctgagtgaggcaatgcctcgccatgcttcggctcgtgcatggtgcgcgcacccactgacttgcgcccagtgtctggcactccctagtgagatgaacccggtacctcagatggaaatgcagaaatcacctgtcttctgtgtcgctcacagtgggagctgtagactggagctgttcccattcggccatcttggctccttc

SEQ ID NO: 12569 - DNA, 6020 bp, Homo sapiens
tatttcttttttttttattattatactttaagttttagggtacatgtgcacattgtgcaggttagttacatatgtatacatgtgccatgctggtgcgctgcgcccactaactcgtcatctagcattaggtatatctcccaatgctatccctcccccctcccccgaccccaccacagtccccagagtgtgatattccccttcctgtgtccatgtgatctcattgttcaattcccgcctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcttttaggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttcattgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattacgttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaagtattttattctctttgaagcaattgtgaatgggagttcactcatgatttggctctcctgttattggtgtataagaatgcttgtgatttttgtacattggttttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgacagtttttagcatgaagcgttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattcccttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcattttgttatgtacccagtagtcattcaggagcaggttgttcagtttccatgtagttgagcagctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctggctgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtatcggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccattctcttctggcttgtagggtttctgccgagagatccgctgttagtctgatgggctttcctttgagggtaacccgacctttctctctggctgcccttaacattttttccttcgtttcaactttggtgaatctgacaattatgtgtcttggagttgctcttctcgaggagtatctttgtggcgttctctgtatttcctgaatctgaacgttggcctgccttgctagattgggaaagttctcctggataatatcctgcagagtgttttccaacttggttccattctccacatcactttcaggtacaccagtcagacgtagatttggtcttttcacatagtcccatatttcttggaggctttgctcatttctttttattctgttttctctaaacttcccttctcgcttcatttcattcatttcatcttccattgctgataccctttcttccagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctctatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgctgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgggcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttg

SEQ ID NO: 12570 - DNA, 5259 bp, Homo sapiens
tttttttctatgatttttttattatactttaagttctagggtacatgtgcacaacatgcaggtttgttacatatgtatacatgtgccatgttggtgtgctgcacccattaactcgtcatttacattaggtatatcttctaatgctatccctccccactccccccaccccacgacaggccctggtgtgtgatgttccccaccccgtgtccaagtgttctcattgttcagttcccacctatgagtgagaacatgtggtgtttggttttctgctcctgtgttcgtttgctcagaatgatggtttccaacttcatccatgtccctacaaaggacatgaactcatccttttttatggctgcatagtattccatagtgtatatgtgccacattttcttaatccagtctgtcattgatggacatttgggttggttccaagtctttgctcttgtgaatagtgccacaataaacatatgtgtgcatgtgtctttctagcagcatgatttataatcctttgggtatatacccggtaatgggatggctgggtcaaatggtatttctagttctagatccttgaggaatcaccacactgtcttccacaatggctgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttacccactttttgatggggttgtttgatttttttcttataaatttgtttaagttctttgtagattctggatattagccctttgtcagatgagtagattgtaaaaattttctcccattctgtaggttgcttgttcactctgatggtagtttcttttgctgtgcagaaactctttagtttaattagatcccatttgtcagttttggcttctgttgccattgcttttggtgttttagtcatgaagtccttgcccatgcctatgtcctgaatggtattgcctaggttttcttctagggtttttatggttttaggtctaagatgtaagtctttaatccatcttgaattaattttgtataaggtgtaaggaaaggatacagtttcagctttctagatatggctagccagttttcccagcactatttattaaatagggaatcctttccccatttcttgtttgtctgtttgtttgtttgttgttgttgttgttgttgttgtttgagatggagtctcgctctgttgcctaggctggagtgcagtgacgcgatctcggctcactgcaagctccacctcccaggttcacaccattctcctgcctcagcttccctagtagctgggactacaggtgcccgccaccacatctggctaatttttttgtattttttagtagagacagacagggtttcaccatgttagccaggatggtcttgatctcccgacctcgtgatccacccacctcggcctcccaaagtgctgggattacaggcgtgagccactgcgcctggccccatttcttgtttttgtcaggtttgtcaaagatcagatggttgtagacatgtggtgttatttctgagggctctgttctattccattggtctatatctctgttttggtacagtaccatgctgttttggttactgtagtatagtttgaagtcaggtagcgtgatgcctccagctttgttcttttggcttaggattgtcttggcaatgcaggctcttttttggtttcatatgaactttaaagtagttttttccaattctgtgaagaaagtcattggtagcttgttggggatggcattgaatctataaattaccttgggcaatatggccattttcacaatattgattcttcctatccatgagcatggaatgttcttccatttgtttgtgtcctgttttatttcactgagcagtggtttgtagttctccttgaagaagtccttcacatccattgtaagttggattcctgggtatttcattctctttgaagcaattgtgaatgggagttcactcatgatttggctctctgtttgtttgttattggtgtgtaggaatgcttgtgatttttgcacagtgattttgtatcctgagactttgctgaagttgcttatcagcttaagaacattttgggctgagacgatggggttttctaaatatacaatcatgtcatttgcaaacagggacaatttgacttcctcgtttcctaattgaataccctttatttctttctcctgccttattgccctggccagaacttccaacactatgttgaataggagtggtgagagagggcatccctgtcttgtgccagtttccaaagggaatgcttccagtttttgcccattcagtacgatattggctgtgggtttgtcataaataactcattattttgagatgcctcccatcaatacctagtttattgagagtttttagcatgaagggctgttgaattttctcaaaggcctttttggcatctattgaaataatcatgtggtttttgtctttggttctgcttttatgatggattacgtttattgatttgtgtatgttgaaccagccttgcatcccaaggatgaagccaacttgatcagggtggataagctttttgatgtgctgctggattcagtttgccagtattttattgaggatttttgcatagatgttttattgaggattttcgcatagatgttcatcagggatattggtctttttttgttgtgtctctgccaggctttggtatcaggatgatgctggcctcataaaatgagttatggaggattccctctttttctattgattggaaaagtttcagaaggaatggtaacagctcctctttgtacctctggtagaattcggctgtgaatccatctggtcctggactttttttggttggtaggctattaattattgcctcaatttcagagtctgttattggtctattcagggattcaacttcttcctggtttagtcttgggagcgtgtctgtgtccgggaatttatccattttatctagattttctagtttatttgtgtagaggtgtttatagtattctctgatggtagtttgtatttctgtgtaatcggtggtgatatcccctttatcattttttattgtgtctattctatccttctctcttttcttctttactagtcttgctagcagtctatcaattttgttcatcttttcaaaaaaccagctctcggattcattgattttttgaagggttttttgtgtctctgtctccttcaattctgctctgatcttagttatttcctgccttctgctagcttttgaatgtgtttgctcttgcttctctagttcttttcattgtgatgttagggtgtcaattttagatctttcttgctttctcctgtggtcatttaatgctataaatttccctctacacactgctttaaatgtgtcccagagattctggtatgttgtgtctttgttctcattggtttcaaagaacatctttatttctgccttcatttagttatgtaccaagtagtcattcaggagcaggttgttcagtttccatgtagttgagtggttttgagtgagtttcttaatcctgagttctagtttgattgcactgtggtctgagagacagcttgttataatttctgttcttttacatttgctgaggagtgcttttcttccaaccatgtggtcaattttggaataagtgtaatgtggtgctgagaagaatgtatattctgttgatttggggtggacagttctgtagatgtctattaggtccgcttggtgcagagctgagttcaattcttggatatccttgttaactttctgtctcattgatctgtttaatgttgacagtggggtgttacagtctcccattattattgtgtgggagtctaagtatctttgtaggtctctaaggacttgctttatgaatctgggtgttcctgtattgggcgcatatatatttaggacagttagctcttcttgttgaattgatccctttaccattatgtaatggccttctttgtctcttttgatctttgttggtttaaagtcccttttatcagagactaggattgcaacccttgcttttttttgttttccatttgcttggtagatcttcctccatccctttattttcagtctatgtgtgtctctgcatgtgagctgggtctcctgaatacagcacactgatgggtcttgactctatccaatttgccagtctgtgtcttttaattggagcatttagtccatttacatttaacgttaatattgttatgtgtaaatttgatcatgtcattatgatgttggctggttattttgctcgttagttgatgcagtttcttcctagcatcgatggtctttacaattaggcatgtttttgcagtggctggtaccgattgttcctttccatgtttagtgcttccttcaggagctcttgtaaggcaggcctggtggtgacaaaatctctcagcatttgcttgtctgtaaaggattgtatttctccttcacttatgaagcttaggttgactggatatgaaattctgggttgaaaattcttttctttaagaacgtcgaatattggcccccactctcttctggcttgtagagtttctgccgagagatctgctgttagtctgatgggcttccctttgtgggtaactcgagctttctctctggctgcccttaacattttttccttcatttcaactttggtgaatctgacaattatgtgtcttggagttggtcttctcgaggagtatctttgtggtgttctctgtatttcctgaattttaatgttggcctgccttgctaggttggggaagttctcctggataatatcctgcagagtgttttccaacttggttccattctccctgtcactttccggtacaccaatcagacatagatttgatcttttcatatagtcccatctttcttggaggctttgttcatttctttttactcttttttctctaaacttctcttctcacttcatttcattcatttgatcttcaatcactgataccctttcttccacttgatagaatcggccactgaagcttgtgcatgcatcacgtagttcttgtgccatgattttcagctccatcaggtcatttaaggtcttttctatgctgttcattctagttagccattcgttta

SEQ ID NO: 12571 - DNA, 6147 bp, Homo sapiens
tattgattatttaattaatttttttttattattatactttaagttttagggtacatgtgcacaatgtgcaggttagttacatatgtatatatgtgccatgctggtgtgctgcacccatcaactcgtcatttagcattagctatatctcctaatgccatccctcgcccctccccccaccccacaacaatccccagactgtgatgttccccttcctgtgtccatgtgttgccattgttcaattcccacctatgagtgagaacatgcggtgtttggttttttgtccctgcaatagtttactgagaatgatgatttccaatttcatccatgtccctacaaaggacatgaactcatcattttttatggctggatagtattccatggtgtatatgtgccacattttcttaatccagtctatcattgttggacattcggattggttccaagtctttgctattgtgaatagtgccgcaataaacatatgtgtccatgtgtcattatagcagcatgatttataatcctttgggtatatacccagtaatgggatggctgggtcaaatggtatttctagttctagatccctgaggaattgccacactgacgtccacaatggttgaactagtttacagtcccaccaacagtgtaaaagtgttcttatttctccacatcctctccagcacctgttgtttcctgactttttaatgactgccattccaactggtgtgagatggtatctcattgtggttttgatttgcatttctctgatggccagtgatggtgagcattttttcatgtgttttttggccgcataaatgtcttcttttgagaagtgtctgttcatgtcctttgcccactttttgatggggttgtttttttcttgtaaatttgtttgagttcattgtagattctggatattagccctttgtcagatgagtaggtggcaaaaattttctcccattttgtaggttgcctgttcactctgatggtaatttcttctgctgtgcagaagctccttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttcagagggctctgttccgttccattgatctatatctctgttttggtaccagtaccatcctgttttggttactgtagccttgtagtatagtttgaagtcaggtagggtgatgcctccagctttgttcttttggcttaggattgacttggtgatgtgggctcttttttggttccatatgaactttaaagtcgttttttccaattctgtgaagaaagtcattggtaggttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgccaaagttgcttatcagcttaaggagattttgggctgagacaatggggttttctagatatataatcatgtcatctgcaaacagggacaatttgacttgctcttttcctaattgaataccctttatttccttctcctgcctaatttccctggccagaacttaaaacactatgttgaataggagtggtgagagagggcatccctgtcttgtgccagttttcaaagggaatgcttccagtttttgcccattcagtatgatattggctgtgggtgtgtcatagatagctcttattattttgagatacgtcccatcaatacctaatgtattgagagtttttagcatgaagaattgttgaattttgtcaaaggccttctctgcatctattgagataatcatgtgttttttgtccttggttctgatatatgctggattacatttattgatttacgtatattgaaccagccttgcatcccagggatgaagcccagttgattttgctggataagctttttgatgtgtattttattgagaatttttgcatcaatgttcatcaaggaaggatattggtctaaaatgctctttttttgttgtgtctctgcccggctttggtatcaggatgatgctggcctcataaaatgagttagggaagattccctctttttctattgattggaatagtttcagaaggaatggtaccagttcctccttgtacctctggtagaattcggctctgaatccatctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcatagaggtgtttgcagtattctctgatagtagtttatatttctgtgggatccgtggtgatatccgctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgttggctcttgcttttctagttcttttaattgtgatgttagggtgtcaattttggatctttcctgctttctcttgtgggcatttagtgctataaatttccctctacacactgctttgaatgtgtcccagagattctggtatgttgtgtcttttttctcgttggtttcaaagaacatctttatttctgccttcatttcattatgtacctagtagtcattcaggagcaggttgttcagtttccatgtagttgagcggttttgagtgagtttcttaaccctgagttctagtttgattgcactgtggtctgagagacagtttgttataatttctgttcttttacatttgctgaggagagctttacttccaagtatgtggtcaattttggaataggtgtggtgtggtgctgaaaaaatgtatattctgttgatttggggtggagagttctgtagatgtctattaggtctgcttggtgcagagctgagttcaattcctgggtatccttgttgactttgtgtctcgttgatctgtctaatgttgacagtggggtgttaaagtccccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggattgcaatccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcattcagtccatttacattgaaagttaatattgttatgtgtgaatttgatcccgtcattatgatgttagctggttattttgctcgatagttgatgcagtttcttcctagtctcaatggtctttacattttggcatgattttgcagcggctggtaccggttgttcctttccatgtttagcgcttccttcaggagctcttttagggcaggccttgtggtgacaaaatctctcagcatttgcttgtctgtaaagtattttatttctccctcacttatgaagcttagtttggccagatatgaaattctgggttgaaaattcttttctttaagaatgttgaatattggcccccactctcttctggcttgtagagtttctgctgagagatccgctgttagtctgatgggcttccctttgagggtaacccaacctttctctctggctgcccttaacattttttccttcatttcaactttggtgaatctaacaattatgtgtcttggagttgctcttctcgaggagtatctttgtggcgttctctgtatttcctgaatctgaatgttggcctgccttgctagatgggggaagttctcctggataatatcctgcagagtgttttccaacttggttccattctccccatcactttcaggtacaccaatcagacgtagatttggtcttttcacatagtcccatatttcttggaggcttgttcgtttctttttattcttttttctctaaacttcccttctcgcttcatttcattcatttcatcttccatcactgataccctttcttccagttgatcgcattggctcctgaggcttctgcattcttcacgtagttctcgagccttggctttcagctccatcagctcctttaagcacttctctgtattggttattctagttatacattcttctaaatttttttcaaagttttcaacttttttgcctttggtttgaatttcctcctgtagctcggagtagtttgatcatctgaagcttcttctctcaactcgtcaaagtcattctgcatccagctttgttccattttgttccattgctggtgaggagctgcgttcctttggaggaagagaggcgctctggtttttagagtttccagtttttctgctctgtttttttccccatctttgtggttttatctacttttgctctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagtgttgtctgcataacagcagatttttgtgaaccgcgaatgctgctgtctgatcgttcctctggaagttttgtctcagaggagtacccggccatgtgaaatgtcagtctgcccctactggggggtgcctcccagttagtctgctcgggggtcagggttcggggacccacttgaggaggcagtctgcccgttctcagatctccagctgtgagctgggagaaccactgctctcttcaaagctatcagacagggacatttaagtctgcagaggttactgctgtctttttgtttttctgtgccctgcccccagaggtggagcctacagaggcaggcaggcctccttgagctgtggtgggctccacccagttggagtttcctggctgctttacctcagcaagcctgggcaatggcaggcgcccttcccccagcctcgctgccgccttgcagtttgatctcagactgctgtgctagcaattagtgagactccgtgggcgtaggaccctccgagccaggtgcgggatatgatctcctggtgcgccgttttttaagcccctcggaaaagcgcagtattcgggtgggagtgacccgattttccaggtgccgtctgtcacccctttctttgactaggaaagggaactccctgaccccttgttcttcccgagtgaggcaatgcctcgccctgcttcggctcgtgcacggtggctgcacccactgtcctgcacccactgtctagcactccctagtgagatgaacctggtatctcagatggaaatgcagaaatcacccatcttctgcgttactcacgctgggagctgtagaccagagctgttcctattcggccatctt

SEQ ID NO: 12572 - DNA, 6076 bp, Homo sapiens
ttctttttttttttcctttcttttttttatttttatttttatttttattttttattattatactttaagttttagggtacatgtgcacattgtgcaggttagttacatacgtatacatgtgccatgctggtgtgctgcacccactaactcgtcatctagcattaggtatatctcccaatgctatccctcccccctcccccaaccccacaacagtccccagagtgtgatgttccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcatattttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttctttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcatcgtagattctggatattagccctttgtcagatgagtaggttgcgaaaattttctcccatgttgtaggttgcctgttcactctgatggtagtttcttttgctgtgcagaagcactttagtttaattagatcccatttgtcaattttgtcttttgttgccattgcttttggtgttttagacatgaagtccttgcccatgcctatgtcctgaatggtaatgcctaggctttcttctagcgtttttatggttttaggtctaacgtttaagtctttaatccatcttgaattgatttttatataaggtgtaaggaagggatccagtttcagctttctacatatggctagccagttttcccagcaccatttattagatagggaatcctttccccattgcttgtttttctcaagtttgtcaaagatcagatagtcgtagatatgcggcgttatttctgagggctctgttctgttccattgatctatatctctgttttggtaccagtaccatgctgttttggttactgtagccttgtagtatagtttgaagtctggtagtgtgatgcctccagctttgttcttttggcttaggattgacttggcgatgcgggctcttttttggttccatatgaactttatagtagttttttccaattctgtgaagaaaggcattggtagcttgatggggatggcattgaatctgtaagttaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctgtgaagcaattgtgaatgggagttcactcatcatttggctctctatttgtctgttgttggtgtataagaatgcttgtgatttttgtacattgattttgtatcctgagactttgctgaagttgtttatcagcttaaggagattttgggctgagacaatggggttttctagatatacaatcatgtcatctgcaaacagggacaatttgacttcctcttttcctaattgaataccctttatttccttctcctgcctaattggcctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgagtatattgaaccagccttgcatcccagggatgaagcccacttgatcatggtggataagctttttgatgtgctgctggatttgttttgccactattttattgaggatttttgcatcaatgttcatcaaggatattggtctaaaattctcttttttggttgtgtctctgccaggctttggtatcagaatgatgctggcctcataaaatgagctagggaggattctctctttctctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgcagaggtgtttatagtattctctgatggtagtttgtattcctgtggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattatgatactagggtgtcaattttggatctttcctgctttctcttgtgggcatttagtgctataaatttccctctacacactgctttgaatgcatcccagagattctggtacgttgtgtctttgttctcattggtttcaaagaacatctttatttctgccttgatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggagtggagagttctgtagatgtctattaggtccgcttggtgcagagctgagttcaattcctgggtatccttgttgactttctgtctagttgatctgtctaatgttgacagtggggtgttaaagtctcccattattaatgtgtcggagtctaagtctctttgtaggtcactcaggacttgctttatgaatctgggtgctcctgtattgggtgcatatatatttaggatagttagctcttcttgttgaattgatccctttaccattatggaatggccttctttgtctcttttgatctttgttggtttaaagtctgttttatcagagactaggattgcaatccctgcctttttttgttttccatttgcttggtagatcttcctctatccttttattttgagcctatgtgtgtctctgcacgtgggatgggcttcctgaatacagcacactgatggatcttgactctttatccaatttgccagtctgtgtcttttaattggagcatttagtccatttacatttaaagttaatagtattatgtgtgaatttgatcctgtcattatgatgttagctggttattttgcttgttagttgatgcagtttttttctagtctcgatagtctttacattttggcatgattttgcagtggctggtaccggttgttcctttccatatttagcgcttccttcagcagctcttttagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatccgctgttagtctgatgggcttccctatgagggtgacccgacctttctctctggctgcccttaacattttttccttcatttcaactttgatgaatctgacaattatgtgtcttggagttgctcttctcgaggagtatctttgtggcgttctctgtatttcctgaatttgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgcttgtttctttttattcttttttctctaaacttcccttctcacttcatttcattcatttcatcttccatcgctgataccctttcttccagttgatcgcatcggctcctgaggcttctgcattcttcacgtatttcttgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccatcttctctcagctcgtcaaagtcattctctgttcagctttgttccgttgctggtgaagagctgtgttcttttggaggaggagaggcgctctgctttttagaatttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgtcggagtaccctgcagtgtgaggtgtcagtgtgcccctgctggggggtgcctcccagttaggctgctcgggggtcaggggtcagggacccacttgaggaggcagtctgcgtgttctcagatctccaactgcatactgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttggagcttccgggctgctttgtttacctaaggaagcctgggcaatggcgggtgcccctcccccagcctcgctgccaccttgcagtttgatctcagactgctgtgctagcaatcagcgagactccgtgggcgtaggaccttccgagccaggtgcaggatataatctcgtggtgcgccgttttttaagcccgtcggaaaagcacagtattcgggtgggattgacccgattttccaggtgccgtccgtcacccctttctttgattaggaaagggaactccctgaccccttgcactttccaagtgaggcaatgcctcgccctgcttcagctcgcgcacggtgcgcgcacccactgacctgcgcccactgtgtggcactccctagtgagatgaacccagtacctcagatggaaatgcagaaatcacctgtcttctgcgtcgctcaggctgggagctgtagaccggagctgttcctattcggccatcttggctcctccctcc

SEQ ID NO: 12573 - DNA, 4726 bp, Homo sapiens
ttgtattaataaactttttttttttaattatactttaagttctagggtacatgtgcacaacgtgcagatctgatacataggtatacatgtgccatgttggtttgctgcacccatcaactcatcatttacattaggtatttctcctaatgctatccctcccccaacccaccacccgcaacaggtcccagtgtgtgatgttccctgccctgtgtccaggtgatctcattgttcagttcccacctatgagtgagaacatgcggtgtttggttttctgtcttgtgatagtttgctgagaatgatggtttccagcttcatccatgtccctgcaaagggcatgaactcatcgttttttatggctgcatagtattccgtggtgtatatgtgccacattttcttaatctagtctatcattggtggatatttgggttggttccaagtctttgctattgtgaatagtgcctcagtaaacatacgtgtgcatgtgtctttatagtagcatgatttataatcctttggatatatacccagtaatgggattgctgggtcaaatggtaattctagttctagatccttgaggaatcgccacactgtcttccacaatggttgaaccagtttacactcccaggaacagtgtaaaagcgttcctatttctccacatcctctccagcatctgttgtttcctgactttttaatgattgccattctaactggcatgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagttctttgtagattctggatattagccctttgtcagagggtagattgcaaaaattttctcccattctgtaggttgcctgttcactctgatggtactttcttttgccatgcagaagctctttagtttaattagatcccatttgtctattatggctttcattgccattgcttttgttgttttagtcatgaagtccttgcctatgcctgtggcctgaatggtatttcctaggttttcttgtagggtttttatggttttaggtctaacatttaagtctttaatccatcttgaattaatttttgtataaggtgtaaggaagggatccagtttcagctttctacatatggctagccagttttcccagcaccatttattaaatagggaatccttttcccatttcttgtttttgtcaggtttgtcaaagatcagatggttttagatgtgtggtgttatttctgaggcctctgttctgttccattggtctatatctctgttttggtaccagtaccatgctgtttcggttattgtagtcttctagtatagtttgaggtcaggtagcctgatgcctccagctttgttcttattccttaggattgtcttggcaatgtgggctcttttttggttccatatgaactttaaagtagtttttttccaattctgtgaagaaagttattggtagcttgatggggatggcattgaattctataaattactttgggcagtatggccattttcacaatattgattcttcctatccatgagcatggaatattcttccatttgtttgtgtcctcttttatttcgttgagcagtggtttgtagttctccttgaagagaattggattcctaggtattttattctctttgtagcaattgtattattctctttgtagcaattgtaaatgggagttcactcatgatttgtctctctgcttgtctgttaatggtgtataggaatgcttgtgatttttgcacattgattttgtatcctgagactttgctgaagttgcctatcagcttaaggagattttgggctgagacgatggggttttctaaatatacaatcatgtcatctgcaaacacaacaatttgacttcctcgtttcctaattgaataccctttatttctttctcttgcctgattgccctggccagaacttccgacattgtgttgaataggagtggtgagagagggcatccttgtcttgtgctggttttcaaagggaatgcttccagtttttgcccattcagtatgatattggctgtgggtttgtcataaatagctcttattattttgagaaacattccatcaatacctagtttattgagtgtttttagcatgaagcactgttgaattttgtcaaaggccttttctgcatctattgggataaccatgtggtttttgtcgttggttctgtttatgtgatggattacgtttattgatttgcatatattgaagcagcctttcttccctgggatgaagccagcttgatcgtggtggataaggtttttggtgtgctactggattcggtttgccagtattttattgaggattttcacattgatgttcatcagggatattggtctaaaattctcttttttttgttgtgtctttgccaggctttggtatcaggatgttgctggcctcataaaatgagttagggaggattccctctttttctattgattggaatagtttcaggaggaatggtaccagctcctctttgtacctctggtagaattcagctgtgaatccgtctggtcctggacttgttttggttggtaggctattattgcctgaatttcagagcctgttattggtctattcagagattgaacttcttcctggttgtcttgggagggtgtatgtgtccaggaatttatccattcctcctacattttctagtttatttgcgtagaggtgtttgtagtattctctgacggtagtttgtatttctgtgggatcagtggtgatatcccctttatcattttgtattgtgtatatttgattcttctctcttttcttctttattagtcttgctagtggtctatcaattttgatgatcttttcaaaaaaccagctcctggattcattgatgttttgaagggttttttttgtgtctatcactttcagttctgctctgatcatagttacttcttgccttctgctaggttttgaatttgtttgctcttgcttctctagttcttttaattgtgatgttagggtgtcaattttagatcttttcctggtttctcttgtgggcatttagtgttataaatttccttctacacactgctttaaatgtgtcccagagattctggtacgttgtgtctttgttctcattggtttccaagaacatctttatttctgccttcatttcgttagttacccagtagtcattcaggagcaagttgttcaatttccatgcagttgtgcagttttgagtgagtttcttaatcctgagttctaatttgattgcactgtggtctgagagacagtttgttgtgatttctgttctttcacatttgctgaggagtgctttacttccaattgtgtggtcaattttggaataagtgtgatgtggtgctgagaagaatgtatattctgttgatttagggtggagagttctgtagatgtctattaggtctgcttgttgcagagctgagttcaggtcctggatatccttgttaaccttctgtctcgttgatctgtccaatattgacagtggggtgttaaagtctcccattattattgtttgggagtctaagtctctttgtaggtctctaaggacttgctttatgaatctgagtgctcctgtattgggtgcatatatatttaggatagttagatcttcttgttgaattgatccctttaccattaggtagtggctttctttgtctcttttgatctttgttggtttaacatctgttttatcagagactgggattgcaacccctgcttttttttgctttccatttgcttgttagatcttcctccatgcctttattttgagcctatgtgcgtctttgcacgtgagatgggtctcctgaatgcagcacactgatgggtctttactctatccaatttgcagtctttgtgttttaattggggcatttagcccatttacatttaagggtaatattgttatgtgtgaatttgatcctgtcattatgatgttcgctggttattttgactgttaattgatgcagtttcttcctagcatcaatggtctttacaatttggcctgtttttgcagtggctggtactggttgtttctttccatgtttagtgcttccttcagaagctcttgtaaggcaagccgggtggtgacacaatctgtcagcatttgcttgtctgtaaaggattttatttctccttcacttaggaagcttagtttggctagatatgaaattctgggttgaaaattcttttcattaagaatgttgaacattggcccctactgtcttctggcttgtagggtttctgctgagagatctgctgttagtctgatgggctttcctctgtggataactcgacctttctctctgactgcccttaacactttttccttcatttcaaccttggtaaatctgacaattttgtgtcttggggttgctcttctcgaggagtatctttgtggcattctctgtattttgtgaatttgaatgttggcctgccttgctaggttggggaagttctcctggataatatcctgaagtgtgttttccaatgtggttccattctccccatcactttcaggtacaccaatcaatcgtaaatttgctcttttcacatagtcccatatttcttggaggctttgtttgtttcttttactctttttt

SEQ ID NO: 12574 - DNA, 6072 bp, Homo sapiens
atacaaatattttttttaaattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccacccacagtgtaaaagtgttcctatttctccatatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttaatgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattgaaatagtttcagaaggaatggtaccagttcctccttgtacctctggtagaatacggctgtgaatccatctggtcctggactctttttggttggtaaactattgattattgccacaatttcagctcctgttattggtctattcagagattcaacttcttcctggtttagtcttgggagagtgtatgtgttgaggaatgtatccatttcttctagattttctagtttatttgcgtagaggtgtttgtagtattctctgatggtagtttgtatttctgtgggatcggtggtgatatcccctttatcattttttattgtgtctatttgattcttctttttttctttattagtcttgctagcggtctatcaattttgttgatcctttcaaaaaactagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatatgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggacaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcgctcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggttattttgctcgttagttgatgcagtttcttcctagtctcgattgtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctaggttggggaagttctcctggataatatcctgcagagtgttttccaacttggttccattctccacatcactttcaggtacaccaatcagacgtacatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtcatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttcgtctttgatgatggtgatgtacagatgggttttcggtgtggatgtcctttctgtttgttatttttccttctaacagacaggaccctcagctgcaggtctgttggaataccctgccgtgtgaggtgtcagtgtgcccctgctggggggtgcctcccagttaggctgctcaggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtgaagcctacagtggcaggcaggcctccttgaactgtggtgggctccacccagttcgagcttcctggctgctttgtttacctaagcaagcctgggcaatggcgggcgcccctcccccagcctcgctgccgccttgcagtttgatctcagaatgctgtgctagcaatcagagagactccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccaacccaaatattttttaagtagctgctcagta

SEQ ID NO: 12575 - DNA, 6031 bp, Homo sapiens
ttttcttatttatttatttatttattattattatactttaagttttagggtacatgtgcacaatgtgcaggttagttacatatgtatacacgtgccatgctggtgcgctgcacccaccaactcgtcatctagcattaggtatacctcccaatgctatccctcccccctgccctcaccccacaacagtccccagagtgtgatgttccccttcctgtgtccacgtgttctcattgttcaattcccacctatgagtgagaatatgcggtgtttggttttttgttcttgcgatagtttactgagaatgatgatttccaatttcattcatgtccctacaaaggacatgaactcatcattttttatgactgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctctgggtatataaccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccattttttgatggggttgtttgtttttttcttgtaaatttgtttgagttcattgtagattctggatattagccctttgtcagatgagtaggttgcgaaaattttctcccattttgtaggttgcctattcactctgatggtagtttcttttgctgtgcagaagctctttagtttaattagatcccatttgccaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatacttgtagatatgcggccttatttctgagggctctgttctgttccattgatctatatctctgttttggcaccagtaccatgctgttttggttactgtagccttgtagtatagtttgaagtcaggtaacgtgatgcctccagctttgttcttttggcttaggatagacttgacgatgcgggctcttttttggtcccatatgaactttaaagtagttttttccaattctgtgaagaaagtcattggtagcttgatggggatagcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttataagttggattcctaggtattttattctctttgaagcaattgtgaatgggagttcactcatgatttggctctgtgtttgtctgttgttggtgtataagaatgcttgtgacttttgtacattgattttgtatcctgagactttgctgaagttgcttatcagcttaaggagattttgggctgagacaatggggttttctagatatacaatcatgtcgtctgcaaacaggaacaatttgacttcctcttttcctaattgaataccctttatttccttctcctgactaattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcattgttgaattttgtcaaaggccttttctgcatctattgagataatcatgtggtttttgtctttgattctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccagctttggtatcaggatgatgctggcctcataaaatgagttagggaagattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcagcttcttcctggtttagtcttgggagagtgtatgtgtcaaggaatttatccatttcttctagattttctagtttatttgcatagaggtgtttatagtattctctgatggtagtttctgtttctgtgggatcggtgatgatatcccctttatcattttttattgtgtctatttgattcttctctcttttttctttattagtcttgctagcggtttatcaattttgttgatcctttcaaaaaaccagctcctggattcattaattttttggagggtttttttgtgtctctatttccttcaattctgctctgattttagttatttcttgccttctgctagcttttgaatgtgtttgctcttgcttttctagttcttttaattgtgattatagggtgtcaattttagatctttcctgctttctcttgtgggcatttagtgctataaatttccctctacacactgctttgaatgcgtcccagagattctagtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgaactgtggtctgagagatagtttgttataatttctgttcttttacatttgctgaggagagctttactttcaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgttgatctgtctaatgttgacagtggggtgttaaagtctcccattattaatgcatgggaatctaagtctctttgtaggtcactcaggacttgctttatgaatctgggtgctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgaaatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcaatggtctttacattttggcatgattttgcagcagctggtactggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttttttaagaatgttgaatattgacccccactctcttctggcttgtagagtttctgccgagagatccgctgttagtctgatgggcttccctttgagggtaacccgacctttctctctggctgttcttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagatgtagatttggtcttttcacatagtcccatatttcttggaggctttgctcgtttctttttattcctttttctctaaacttcccttctcgcttcatttcattcatttcatcttccatcactgataccctttcttctagttgatcgcatcagctcctgaggcttctacattcttcacgtagttctcgagccttggttttcagctccatcagctcctttaagcacttctctgtattggttattctagttattcattcttctaaattcttttcaaagttttcaacttctttgcctttggtttgaatgtcctcccatagttcggagtaatttgatcgtctgaagccttcttctctcagctcgtcaaagtcattctccgtccagctttgttccattcctggtgaggaactgcattcctttggaggaggagaggagctctgctttttagagtttccagtttttctgctctgttttttccccatctttgtggttttatctacttttggtctttgacgatggtgatgtacagatgggttttttgtgtggatgtcctttctgtttgttagttttccttctaacagacaggaccctcagctgcaggtctgttagagtacccggccgtgtgaagtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttcagtctgcagaggttactgctgtctttttgtttgtctgtgccctgcccccagaggtggagcctacagaggcaggcaggcctccttgagctgtggtgggctccacccagttcgagcttcccggctgttttgtttacctcagcaagcctgggcaatggcgggcgcccctcctccagcctcgctgccaccttgcagtttgatctcagactgctgtgctagcaatcagcgagactctgtgggcgtaggaccctctgagccaagtgcgggatataatctcctggtgggccgttttttaagcccgtcggaaaagcgcagtattcgggtgagagtgacccgattttccaggtgccctctgtcacccctttctttgactaggaaagggaactccctgaccccttgtgcttcctgagtgaggcaatgcctcgccctgcttcggctcacgcacggtgcgcgcacccactgacctgtgcccactgtctggcactccctagtgagatgaacctcagatggaaatgcagaaatcacctgtcttctgcgttgctcacgctgggagctgtagaccggagctgttcctatttggccatcttg

SEQ ID NO: 12576 - DNA, 6088 bp, Homo sapiens
tttttttttttttttttttttttttttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatcatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaaaatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatctcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcagtcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtgttgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccccttcactgtgtttt

SEQ ID NO: 12577 - DNA, 5750 bp, Homo sapiens
ttcttagtgtttttttaaattattatactttaacttctagggtacatgtgcacaacatgcaggtttgttacatatgtatgcatgtgccatgttggtgtgttaactcgttaactcgtcatttacattaggtatatctcctcatgctatgcctcccacctccgcccaccccaggacaggccctggtgtgtgatgttccccaccctgtgtctaagtgttctcattgttcaattcctacctgtgagtgagaacatgcggtgtttggttttctgtccatgcgatagtttgctcagaatgatggtttccagcttcatccatgtccctataaaggacatgaactcattcttttttatggctgtgtagtattccatggtgtatatgtgccacattttcttaatccagtctatcactgatggacatttgggttggttccaagtctttgctattgtgaatagtgccacaataaacatatgtgtgcatgtgtctttatagaagcatgatttataatactttgggtatatacccagtaatgggatggctgggtcaaatgggatttctagctctagatccttgaggaatcgccacactgtcttccacaatggttgaactagtttacagtcccaccaacagtgtaaaagtgttcctatttctccacatcctctccagcacctgttgtttcctgacttcttaatgatcgccattctaaccggtgtgagatggtatctcactgtggttttgattttcatttctccgatggccagtgatgagcattttttcatgtctgttggctgcataaatatcttcttttgagaagtgtctgttcatatcctttgcccactttctgatggggtcgtttgatttttttcttataaatttgtttaagttctttgtagattctgaatattagccctttgtcagatgggtagattgtaaaaattttctcccattttgtaggttgcctgttcactctgatggtagtttctgttgctgtgctgaagctctttagtttatttagatcccatttgtcaattttggcttttgttgccattgcttttggtgttttagtcatgaagtccttgcccatgcctaggtcctgaatggtattgcctaggttttcttctagggtttttatggttttaggtctaacatttaagtctttaatccatcttgaattaatttttgtgtaaggtttaaggaagggatccagtttcagctttctacatatggctagctagttttcccagcaccatttattaaatagggaatcctttccccatttcttgtttttatcaggtttgtcaaagatcagatggttgtagatgtgtggtattatttctgagggctctgttctgttccattggtccatatctctgttttggtaccagtaccatgctgttttggttactgtagccttgtagtgtagtttgaagtcaggtagcatgatgcctccagctttgttcttttggcttaggattgtcttggcaacgtgggctcttttttggttccatatgaactttaaagtagttttttccaattctgtgaagaaagtcattggtagcttgatggggattgcattgaatctataaattaccttgggcagtatggccattttcatgatattgattcttcctatccatgagcatagaatgttcttccatttgtttgtgtcctcttttattttgttgagcagtggtttgtagttcttgaagaggtccttcacatcccttgtaagttggattcctaggtattctattccctttgaagcaattctgaatgggagttcactcatgatttggcctgttattggtatataggaatgcttgtgatttttgcacattgattttgtatcctgagactttgctgaagttgcttatcagcttaaggagattttgggtggagacgatggggttttctaaatatacaatcatgtcatctgcaaacagggacaatttgacttcctcttttcctaattgaatacgctttatttctttctcttgcctgattgtcctggccagaacttccaacactgtgttgaataggagtggtaagagagggcatccctgtcttgtgccagttttcaaagggaatgcttccagtttttgcccattcggtatgatattggctgtgggtttgtcataaataactctgattattttgagatacatcccatcaatacctagtctagggctgggcgcggtggcttacgcctgtaatcccagcactttgggaggctgaggcaggcggatcacaaggttaggacatcgagaccatcctggctaacacagtgaaaccccatctctactaaaaatacaaaaaattagccgggcgtggtggcgggcgcctgtagtcccagctactcaggaggctgaggcaggagaatggtgtgaacccgggaggcagagcttgcagtgagcagaaatcgtgccactgcactccagcctgggcgacagagcaagactccttctcaaaaaaacaaaatgaaacaaaacaaaagaaatacctagtctattgaaagtttttagcatgaagggctgttgaattttgtcgaaggccttttctgcatctattgagattatcatgtggtttttgtcattggttctgtttatgtgatggattatgtttattgatttgcgtatgttgaaccagccttgcatcccagtgatgaagccaacttgattgtggtggataagctttttgatgtgctgctggattcagtttgccagtattttattgaggatttttgcatcgatgttcatttggggatattggtctaaaattctccttttttgttgtatttctgccaggctttggtatcaggatgacgctggcctcataaaatgagttagggaggagtccctctttttctattgattggaatagtttcagaaggaatggtaccagctcctctttgtacctctggtagaatttggctgtgaatccgtctggtcctggactttttctggatggtaggctattgttgcctcaatttcagagcctattgttggtctattcagggattcaacttcttcctggtttagtcttgggagggtgtatgtgttgaggagtttatccatttcttctagattttctagtttatttgcatggaggtgtttatagtgttctctgatggtagtttgtatttctgtgggatcggtgttgatatcccatttatcattttttattgcatctatttgattcttctatcttttcttctttattagtcttgctagcagtctatcaattttgttgatcttttcaaaaaatcagctcctggattcattgattttttgaagggtttttcgtgtttctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccttctatgtactgctttaaatgtgtcccagagattctggtatgttgtgtctttgttctcattggtttcaaagaacatctttctttctgccttcattttgttatgtacccagtagtcattcaggagcaggttgttcagtttccatgtagctgagcgattttgagtgagtttcttaatcctgagttctagtttgattgcactgtggtctgagagacagtttgttacaatttctgttcttttacatttgctgaggagtgctttacttccaactatgtggtcagttttggaataagtgcgatgtggtgctgagaagaatgtgtgttctgttgatttggggtagagagtttggtagatgtctattaggtctgctcggtgcagagctgagttcaagtcctggatatccttgttaactttctgtctcattgatctgtctaatgttgacagtggggtgttaaagtctcccattattattgtgtgggagtctaaatctctttgtaggtctttaagggcttgctttatgaatctggatgctcctgtattgggtgcatatatatttaggatagttagctcttcttgttgaattgatccctttaccattatgtaatggccttctttgtctcttttgatctttgttggtttaaagtctgttttatcagaaactaggattgcaactcctgctttttttttgctttccatttgcttggtagatcttcctccatccctttatgttgagcctatgtgtgtctctgcacgtgagatgggtttcctgaatacagcacactgatgggtcttgactctttatccagtttgccagtctgtgtcttttaatgggagcatttagcccatttacatttaaggttaatatttttatgtgtgaatttgatcctgtcattatgatcttagctggttattttgctcgttagttgatgcggtttcttcctagcatcaatggtctttacaatttgacatgtttttgcagtggcttgtaccggttgttcctttccatgtttattgcttccttcaggagctcttgtaaggcaggcctggtggtgacaaaatctctcagcatttgtttgtctgtaaaggattttatttctccttcacttatgaagcttagtttggctggatatgaaattctgggttgtaaattcttttctttaagaatgttgaatattggcccccactctcttctggcttgtagagtttctgccgagagacctgctcttagtctgatgggcttccctttgtgggtaacccgacctttctctctggctgcccttaatattttctccttcatttcaactttggtgaatctgacaattatgtgtcttggagttgctcttcttgaggagtatctttgtggtgttctctgtatttcctgaatttgaatgttggcctgccttgctaggctggggaagttctcctggataatatcctgaagagtgttttccaacttggttccattctccctgtcattttcaggtacaccaatcagacgtagatttggtcttttcatatagtcctatatttcttggaggctttgtttgtttctttttactcttttttctctaaacttctcttcttgcttcatttcattcatttgatcttccatcactgataccctttctttcacttgatcaaatcagctactgaagcttgtgcatgcgtcatgtagttcttgtgccatggtttttagctccatcaggtcatttaaggacttctctacactgtttattctagttagccattcgtctaatcttttctcaaggttttagcttctttgcgatgggctcgaacatcctcctttagctcggagaagtttgttattaccgatcgtctgaagccgccttctctcaactcgtcaaagtcattctctatccagctttgttccgttgctggcgaggagctgcgttccttgggaggggaagaggagctctgatttttataattttcagcttttctgctctggtttatccccatctttgtggttttatctacctttggtctttgatgatggggacgtacagatggagttttggtgtggatgtcctttctgtttgttagttttccttctaacagtcaggaccctcagctgcaggtctgttggagtttgctggaggtccactccagaccctgtttgcctgggtatcacagcagaggctgcagaacagcaaatattgcagaatggcaaatgttgctgcctgatccttcctctggaagcttcgtctcagaggggcacccggtcgtatgaggtgtcagttggcccctattgggaggtgtctccca

SEQ ID NO: 12578 - DNA, 6049 bp, Homo sapiens
ttatctaaataaattttttcttttattattatactttaagttttagggtacatgtgcacattgtgcaggttagttacatatgtatacatgtgccatgctggtgcgctgcacccactaactcgtcatctagcattagatatatctcccaatgctatccctcccccctccccccaccccacaacagtccccagagtgtgatgttccccttcctgtgtccatgtgatctcattgttcaattcccacctatgagtgagaatgtgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctgtcattgttggacatttgggttggttccaagtctttgctattgtgaatagtgacgcaataaacatacatgtgcatgtgtctttatagcagcatgatttatagtcctttgggtatatacccagtaatgggatggctgggtcaaatggtattctagttctagatccctgaggaatcgccacactgacttccacaatggttgaactagtttacagtcccaccaacagtgtaaaagtgttctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatgggattgtttgtttttttcttgtaaatttgtttgagttcattgtagattctggatattagccctttgtcagatgagtaggttgcgaagattttctcccattttgtaggttgcctgttcactctgatggtagtttcttttgctgtacagaagctctttattttaattagatcccatttgtcaattttgtcttctgttgccattccttttggtgttttagacatgaagtccttgcccatgcctatgtcctgaatggtattgcctaggttttcttctagggtttttatggttttaggtctgacgtttaaatctttaatccatcttgaattgatttttgtataaggtgtaaggaagggatccagtttcagctttctacatatggctagccagttttcccagcaccgtttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagtttttttccatttctgtgaagaaaggcattggtagcttgatgaggatggcactgaatctgtaaattaccttgggcagtatggccattttcacgatattgattcttcctacccatgagaatggaatgttcttccatttgtttgtatcctcttatttcgttgagcagtggtttgtagttctccttgaagaggtccttcacatcccttggaagttggattcctgggtattttattgtctttgaagcaattgtgaatgggagttctctcatgatttggctctctgtttgtctgttgttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgacttcctcttttcctaattgaataccctttatttccttctcctgcctaattgccctggccagaacttccaacaccatgttgaataggagtggtgagagagggcatccctgtcttgtgccagttttcaaagggaatgcttccagtttttgcccattgagtatgatattgtctgtgggtttgtcatagatagctcttattattttgaaatatgtcccatcaatacctaatttgttgagagtttttagcatgaagggttgttgaattttgtcaaaggctttttctgcatctattgagataatcatgtggtttttgtctttggctctgtttatatgctggattacatgtattgatttgcgtatattgaaccagtcttgcatcccagggatgaagcccacttaatcatggtggataagctttttgatgtgctgctggattcgttttgccagtattttattgaggatttttgcatcaatgttcatcaaggatattggtctaatattctcttttttggttgtgtctctgccaggctttggtatcagaatgatgctggactcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgttggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttggtcttgcttttctagttcttttaattgtgatgttagggtgtcaattttggatctttcctgctttctcttgtgggcatttagtgctataaatttctctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaaatctcccattattaatgtgtgggggtctaagtctctttgtaggtcactcaggacttgctttatgaatctgggtgctcctgtattgggtgcatatatatttaggatagttaactcttcttgttgaattgatccctttaccattatgtaatggccttctttgtcttttttgatctttgttggtttaaagtctgttttatcagagactaggattgcaacccctgcctttttttgttttctatttgcttggtagatcttcctccatccttttattttgagcctatgtgtgtctctgcacgtgagatgggtttcctgaatgcagcacactgatgggtcttgactctttatccaatttgccagtctatgtcttttaattggagcatttagtccatttacatttaaagttaatattgtgatgtgtgaatttgatcctgtcattatgatgttagctggttattttgctcgttagttgatgcagtttcttcctagtctcaatggtctttacattttggcatgattttgcagtggctggtaccggttgttcctttccatgtttagtgcttccttcaggagctcttttagggcaggcctggtggtgacaaaaatctctcagcatttgcttgtttgtaaagtattttatttctccttcacttatgaagcttagtttggctggatatgaaattctgtgttgaacattcttttctttaagaatgttgaatattggcccccactcccttctggcttgtagagtttctgctgagagatcaggtgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgttagattggggaagttctcctagataatatcctgcagagtgtttttcaacttggttccattctccgcgtcactttcaggtacaccaatcagatgtagatttggtcttttcacatagtcccatatttcttggaggctttgctcatttctttttattctttttttctctaaacttcccttctcgcttcatttcattcatttcaccttccattgctgataccctttcttccagttgatcgcatcggctcctgaggcttctgcattcttcacgtagttctcgagccttggttttcagctccatcagctcctttaagcacttctttgtattggttattgtagttatacattcttctaaatttttttcaaagttttcaacttctttgtctttggtttgaatgtcctcccgtagctcagagtaatttgatcgtctgaagccttcttctctcaacttgtcaaagtcgttctccgtccagctttgttccgttgctggtgaggaactgcgttcctttggaggaggagaggcgctctgctttttggagtttccagtttttctgttctgttttttccccatctttgtggttttatctccttttggtctttgatgatggtgatgtacagatgggtttttggtgtggatgtcctttctgtttgttagttttccttctaacagacaggaccctcagctgcaggtctgttggagtaccctgccgtgtgaggtgtcagtgtgcccctgctagggggtgcctcccagttaggctgttcgggtgtcaggggtcagggacccacttgaggaggcagtctgcccgttctcagatctccagctgcgtgctgggagaaccactgctctcttcaaagctgtctgacagggacatttaagtctgcagaggttactgctgtctttttgtttgtctgtgccctgcccccagaggtggagcctacagaggcaggcaggcctccttgagctgtgtgggctccacccagttcgagcttcctggctgctttgtttacctaagcaagcctgggcaatggcgggcgcccctcccccagcctcgctgccgccttgcagtttgatctcagactgctgtgctagcaatcagggagactccatgggcgtaggaccctccgagccaggtgtgggatataatctcgtgctgcgctgttttttaagccggtcggaaaagcgcagtatttgggtgggagtgacccgattttccaggtgccatccgtcacccctttctttgactaggaaagggaactcgctgaccccttgcgcttcccgagtgaggcaatgcctcaccctgcttcggctcgcacacggtgcgcgcacccactgatctgcgcccactggcactccctattgagatgaacccggtacctcagatggaaatgcagaaatcacccgtcttctgcgttgctcacgctgggagctgtagaccggagctgttcctattcggccatcttggctcctcccccagtaaatt

SEQ ID NO: 12579 - DNA, 6046 bp, Homo sapiens
agtaatttttcttttttttttattatactttaagttttagggtacatgtgcacatcgtgcaggttagttacatatgtatacatgtgccatgctggtgcgctgcacccactaactcgtcatctagcattaggtatatctcccgatgctatccctcccccctccccccaccccacaacagtccccagagtgtgatagtccccttcctgtgtctatgtgatctcatagttcaattcccacctatgagtgagaatatgcggtgtttggtttttttgttcttgcgatagtttactgagaatgatgatttccaatttcatccatgtccctacaaaggacatgaactcatcatttttttatggctgcaaagaattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatgtgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcttatgtcgtgaatggtaatgcctaggttttcttctaggggttttatggttttaggtctaacgtttaagtctttaatccatcttgaattgatttttgtacaaggtgtaaggaagggatccagtttcagctttctacatatggctagccagttttcccagcaccatttattcaatagggaatcctttccccattgcttgtttttctcaggtttgtcaaagatcagatagttgtagatatgcggcgttatttctgagggctctgttctgttccattgatctatatctctgttttggtaccagtaccacgctgttttggttactgtagccttgtagtatagtttgaagtcaggtagtgtgatgcctccagctttgttctcttggcttaggactgacttggcgatgcgggctctgttttggttcatatgaactttaaagtagttttttccaattctgtgaagaaaggcattggtagcttcatgaggatggcattgaatctgtaaattaccttgggcagtatggtcattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcaggatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaggtttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtgtatatgctggattacatttattgatttgcgtatattgaaccagccttgcatcccagggatgaagcccacttgatcatggtggataagctttttgacgtgctgctggattcgttttgccagtattttattgaggatttttgcatcaatgttcatcaaggatattggtctaaaattctctttttttgttgtgtctctgcctggctttggtatcagaatgatgttggcctcaaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagagcctgttattggtctattcagagattcaacttcttcctggtttagtcttgggagggtgtatgtgtccaggaatttatccatttcttctagattttctagtttatttgcgtagagctgtttgtagtattctctgatggtagtttctatttctgtgggatcggtggtgatatcccctttatcattttttattgcgtctatttgattcttctctctttttttctttattagtcttcctagcggtctatcaattttgttgatcctttcaaaaaaccagctcctggattcattaattttttaaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctctttttggcatttagtgctataaatttccctctacacactgctttgaatgtgtcccagagattctggtatgttgtgtctttgttctcgttggtttcaaagaacatctttatttctgccttcatttcactatgtacccagtagtcattcaggagcaggttgttcagtttccatgtagttgagcggttttgagtgagattcttaatcctgagatcgagtttgattgcactgtggtctgagagatagtttgttataatttctgttcttttacatttgctgaggagagcttcacttccaactatgtggtcaattttggaataggtgtggtgtggtgctgaaaaaaatgtatattctgttgatttggggtggagagttctgtagatgtctattaggtccacttggtgcagagctgagttcaattcctggttatccttgttgactttctgtctcgttgatctgtctaatgttgagagtggggtgttaaagtctcccattattaatgtgtgggagtctaagtttctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagtctcgatggtctttacatttaggcatgattttgcagtggctggtaccggttgttcctttccatgtttagtgcttccttcaggaactcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctactctcttctggcttgtagggtttctgccgagagatcagctgttagtctgatgggcttccctttgagggtgacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgccagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgacaccctttcttccagttgatcgcatcggctcctgaggcttctgcattcttcacgtagttcttgagccttggttttcagctccatcagctcctttaagcacttctctgtattggttattctagttataccttcttctaaatttttttcaaagttttcaacttctttgcctttggtttgaatgtcctcccgtagctcagagtaatttgatcatctgaagccttctctcagctcgtcaaagtcattctccatccagctttgttccgttgctggtgaggaactgcgttcctttggaggaggagaggcactctgctttttagagtttccagtttttcttttctgttttttccccaactttgtggttttatctacttttggtctttgatgatggtgatatacagatggacttctggtgtggaagtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagagattactgctgtctttttgtttgtctgtgtcctgcccccagaggtggagcctacagaggcaggcaggcctccttgagctgtggtgggctccacccagttcgagcttcccggctgctttgtttacctaaggaagcctgggcaatggcgggcgcccctcccccagcctcgctgccgccttgcagtttgatctcagactgctgtgctagcaatcagggagactccgtgggcgtaggaccctccgagccaggtgcgggatataatctcctggtgcgccgttttttaagcccgtcggaaaagcgcagtattccggtaggagtgacccgattttccaggtcccgtctgtaacccctttctttgactcagaaagggaactccctgaccccttgcgcttcccaagtgaggcaatgccttgccctgcttcggctcacgcacggtgcgcgcacccactgacctgcgcccactgtgtggcactccctagtgagatgaacccggtacctcagatggaaatgcagaaatcacccgtcttctgcgtcgctcaagctgggagctgtagaccagagttgttcctatttggccatcttggctcctccccccagtaattt

SEQ ID NO: 12580 - DNA, 5691 bp, Homo sapiens
tatgttgctaggtgattttttatttatttttttattatactttgagttttagggtacatgtgcacaatgtgcaggtttgttacatatgtatacatgtgccatgttggtgtgctgcacccattaactcatcatttaacattaggtatatctcctaatgctacccctcctccctacccccaccccacaacaggccctggtgtgtgatgttccccttcctgtgtccatgtgttctcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctgtatagtagcatgatttataatcctttgggtatatacccagtaatgggatagctgggtcaaatggtatttctagttctagatccctgaggaatcgccacactgacttccacgatggttgaactagtttacagtcccaccaacagtgtaaaagtgttcctatttctccacatcctctccagcacctgttgcttcctgactttttaatgattgccattctaactggtgtgagacggtatctcattgtggttttgatttgcatttctctgatggccagtgatgatgagcattttttcatgtgtcttttggctgcataaatgtcttcttttcagaagtgtctgttcatatccttcacccactttttgatggggctgtttgtttttttcttgtaaatttgtttgagttctttgtagattctgggtattaaccctttgtcagatgagtagattgcaaaaattttctcccattttgtaggttgcctgttcactctgatggtagtttcttttgctgtgcagaagctctttagtttaattagatcccatttgtcaattttggcttttgttgcccttgcttttagtgtttcagacatgaagtccttgcccatgcctatgtcctgaatggtattgcctaggttttcttctatggtttttatggttttaggtctaacatttaagtctttaatccatcttgaattaatttttgtataaggtgtaaggaagggatccagtttcagctttatacatatgactagccagttttcccagcaccatttattaaatagggaatcctttccccatttcttgtttttgtcaggtttgtcaaatatcagatggttgtagatatgtggcattatttctgagggctccattctgttccattggtctatatctctgttttggtaccagtaccatgctgttttggtttctgtagccttgtagtatagtttgaagttaggtagtgtgatgcctccagctttgttcttttggcttaggattgacttggcaatgcaggctcttttttggttccatatgaactttaaagtggttttttccaattctgtgaagaaaatcattggtagcttgatggggatggcattgaatttataaattaccttgggcagtatggccattttcacgatattgattcttcctacccatgagcatggaatgttcttccatttgtctgtatcctcttttatttcattgagcagtggtttgtagttctccttgaagaggtccttcacatcccttgtaagttggattcctaggtattttatcctctttgaagcaattgtgaatgggagttcactcatgatttggctctctgttagtctgttgttggtgtataagaatgcctgtgatttttgcacattgattttgtatcctgagactttgctgaagttgcctatcagcttaaggagattttgggctgagatgatggggttttctagatatacaatcatgtcatctgcaaacagggacaatttgacttcctcttttcctaattgaataccctttatttccttctcctgcctgattaccctggccagaacttccaacactatgttgaataggagtggtgagagagggcatccctgtcttgtgccagttttcaaagggaatgcttacagtttttgcccattcagtatgatattggctgtgggtttgtcacggatagctgttattattctgagatacatcccatcaatacctaatctattgagagtttttagcatgaagcgctgttgaattttgtcaaaggccttttctgcatctattgagataatcatgtggtttttgtcattggttttgtttatagcctggattacgtttactgatttgcgtatgctgaaccagccttgcatcccagggatgaagcccacttgatcatggtgtttaagctttttgatgcgctgctggatttggtttgccagtattttattgaggatttttgcatcaatgttcatcagggatattggtctaaaattctctttttttgttttgtttctgccaggctttggtatcaggatgatgctggcctcataaaatgagttaggaaggattccctctctttctattgattgtaatagtttcagaagcaatggtaccagctcctccttgtacctctggtagaattcggctgtgaatccatctggtcctggactttttttggttggtaagctattaattattgcctcaatttcagagcctatttttggtctattcagagattcaacttcctcctggtttagtcttgggagggtgtatgtgtcgaggaatttatccatttcttctagattttctagtttatttgtgtggaggtgtttatagcattctctgatggtagtttgtatttctgtgggatcggtggtgatatcccctttatcattttttattgcatctatttgattcttctctcttttcttctttattagtcttgctagtggtcggtcaattttgttgatcttttcaaaaaaccagctcctggattcattgattttttttgaagggttttttgtgtctctgtttccttcagttctgctctgatcttagttatttcttgccttctgctagtttttgactgtgtttgctcttgcttctctagttcttttaattgtgatgttagggtgtcaattagatcttttctgctttctcttgtgggcatttagtgctgtaaatttccctctacacactgctttgaatatgtcccagagattctggtatgttctgtctttgttctcgttggtttcaaagaacatctttatttctgctttcatttcgttatgtacccagtagtcattcaggagcaggttgttcagttttcatgtagttgagcggttttgagtgagtttcttaatcctgagttctagtttgattgcaccgtggtctgagagacagtttgttataatttctgttcttttccatttgctgaggagagctttacttccaactatgcagtcaattttgtaatgggtgtggtgtggtgctgaaaagaatgtatattctgttgatttggggtggagaattctgtagatgtctattaggtccacttggtgcagagccgagttcaattcctggatatccttgttaactttctgtcttgttgatctgtctaatgttgacagtagggtgttaaagtctcccattattattgtgtgggagtctaagtctctttgtaggtctctaaggacttgctttatgaatctgggtgctcctgtattgagtgcatatatatttaggatagttatctcttcttgttgaattgatccctttaccattatgtaatggccttctttgtctcttttgatctttgttggcttaaagtctgttttatcagagactaggattgcaacctctgcctttttttgttttccatttgcttggtagatcttcctccatccctttattttgagcctatgtgtgtctctgcacatgagatgggtttcctgaatatagcacactgatgggtcttgactccttatccaatttgccagtctgtgtctttaatttggagcatttagcccatttacatttaaggttaatatggttatgtgtgaatttgatcttgtcattatgatgttagctggttattttgctcattagttgatgcagtttcttcctagcctcaatggtctttacaatttggcatgtttttgcagtggctggtactggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagaggtcagctgttagtctcatgggcttcccttcgtggataacccaacctttctctctggctgcccttaacattttttccttcatgtcaactttggtgaatctgacaattatgtgtcttggagttgctcttcttgaggagtatctttgtggcgttctctgtatttcctgaatatgaatgttgtcctgccttgctagatttgggaagttctcctggataatatcctgcagagtgttttccaacttggttccattctccctgtcactttcaggtacaccaatcagatgtagatttggtcttttcacatagtcccgtatttcttggaggctttgttcatttctttttattcttttttctctaaagttctcttcttgctttatttcatccatttgatcttctatctctgataccgtttcttccagttgatcaaattggctactgaggcttgtgcattcatcacgtagttctcatgccttggttttcagctccatcaggtcctttaaggacttctctgcattagttattctagttagcctttcgtctaattttttttcaaggtttttaacttctttgccatgggttcgaacttcctcctttagctcggagtagtttgatcgtctgaagccttcttatctcaactcgtcaaagtcattgtccgtccagctttgttccattgctggtgaggagttgcgttcctttgggggaggagaggtgctctgatttttagagtttccagtttttctgctctgttttttccccgtctttgtggttttatctacctttggtctttgacgatggtgacatacagatggagttttggtgtggatgtcctttctgtttgttagttttccttctaacagtcaggacccacagctgcaggtctgttggagtttgctggaggtccactccagaccctgtttgcctgggtatcagcagtggaggctgcagaacagcggatattggtgaccagcaaatattgctgcctgatcattcctctggaagttttatctcagaggagcacccggctgtgtgaggtgtcagtctgtccctactggggggtgcctcctagttaggctactcgggggtcagggacccacttgaggagacagtctgtccattctcagatctccagctgcgtgctgggagaaccactactctcttcaaagctgtcagacagggacatttaagtctgcagaggattctgctgccttttgtttggctatgccctgcccccagaggtggagtctacagaggcaggcaggcctccttgagctgcggttggctccacccagttcgagcttcctgg

SEQ ID NO: 12581 - DNA, 14945 bp, Homo sapiens
tttaccaattgtgtaacttctttttttttttttattatactttaagttttagggtacatgtgcacattgtgcaggttagttacatatgtatacatgtgccatgttggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacattttcttaatccagtctatcattgttggacatttgggttggttccaagtctttgctattgtgaataatgccgcaataaacatacgtgtgcgtgtgtctttatagcagcatgatttatagtcatttgggtatataccctgtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttacctgactttttaatgattgccattctaaccggtgtgagatggtatctcattgtggttttgatttgcatttccctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagtgctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtacaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctccgttttggtaccagtaccatgctgtaaagttaaatgtaattatgttgtggaggttatgtctctttttccagcattcttgaaagtaaaagattttcacaactgtctattattgtccaccaagaaacatatgaggaagcaaaatgaattttaataatagcataaaatctgagaaagacacatgtaaatatagtattttaaggttcttatatgaataaagtgatgtgttcttatttaaacatgtatgtataatccctatatcaaccaacataaaagttaaaaataaatcattaaactgcccactcagttttaaaagcggataagaatacaagttgaatagtataaagattagttaaaaataaaacagtgacatgacaaacttaaagtagacaatttcaataattatgttaaatacagactaagatatgaactgtcagatcagataaaaaaacaagaccctactatatgctgtctacaaatcttgttttcaataaaaagatacaaattaaaggtaaaatgataaagataccctatgctaaaatagctagagaaacaatactaacatgatccacttaatacataaaagacacttggcaacatcctgcattaattttataaaaaataataaatttacccacttcctcaacttgataaaggatatctacagctaatatccagtacttattgctgcaagcctcagtgctcttctcttgatgttagaatgaaggcaagtatgtatattctcaccatttctagtcaacattttcctacagacctggcctgtacactagggcaagaaaaagaaataaaaggctttttggaaaccaaaagtcatgattgcctatgcagaaaatttagtgaataatacccacaaaacattctgctagaatcaatcagcaagttttacaaggaaataatatacaagatcaatatataaaactcaattatacttttttatgcaaataatgaaaaatcagaaattgagataaaaataacgttaaaatatcaccaagtataaaagcacctctagagcatttgagtaaagagttctaaaagtgtgttcctcaatcaaagcaatgataatagggcaaaacttatcaaaatcaactatttcagaattctggaatagttgagaaggcctgcaaaaattcaaggagcattcattcaagagaaatggctaaatcctggggaaaaatttcctgctttccttgggaatggcagggagggggcagggaatgtcaggatattttgtaatgctgctaatgactctgggatcacaaaatatataacagggcattggcaaataacagtatcttttgatatatcaagtagcacattacattttacatgtaatagaaaacctttctgaaacataatttcatattttggcttcatcttttataggttataaatacctatatttataacctatataaatgtaacttatgtttatttatacaagcccaaatgtaacttatgtttagtaatgctaaattatatttacatagatatcaaaacaattgtttacatttttactatcattaacaagatcaattgttttgttaatataaaactacagcctcttgtatttgtgaattgttgttttacatagctaaggtatttaaatacctatttatgaattcagttatattaactgaactacttttttatcatcaagcaagataaacatttactgaaaattatgtattttatagaacaggtgaaacttttaccaatacattgctgttttaccacttattaaattttatttttatcctatggttggtctagcttggaagctaaaaattaagtggaattatcggatatcataagaatctgcctgatttagacttcatgaatctaaatgttcttattacttttattttaaaatagcttcctacgggtttgtaattcagacaaattgtttgaatttctgaaacaaataagcaaaatagagtcttgatattgtttgctctctgaatttattactgcttagatcaaaaaagctgaggaaggatggtctcatgatattgaatttgtaacacattacattctagaagatacagacttggaattaaaattcaacttgacattttaaaatgttattaaatttactatcagtcagaacattctgtagaacagaacattttcattgaatctatggcaaactattttggtttggcatttagggctcaattactttggaaggacatttgcccatagaagctgattgattcattcatattccatccccaaagatatcatagtttaaaaagggaactgcatccccattccttaatgtgttgattattaaatagtcatgattaagcttatgtttctgaaataataactacctttgagattattttaccttaaaaatatagcaaattctaacataattaacaaaatataaaatagtgatatcatgggagatttcttttagtgcccactaatacttgggtagtattcaaacatttttattaaaattatcctgttggttccttgtgttctatcagtaataagattagttaatacacagtgatttccacggcaagaatttagactgctaaaagcaagaattagagaggccaaaacactaaatgcctagagtgtgtgattagtaacgtttttctttatctcagtgcttttgaacaagtcactgacttttctgagatgtataaccttttaattttaattttcttcaatgaatgcctaaaatttttgtggtgactcttcttcaaaaataaataacactattacagaaatcaaacttagtaaagaaactgagttgatgtcaatacatatatatatatatatatatatatataccatacacatatatacacatgcacacattcatacacatatatactctttcctgcaatgtggaatgtccaatcccgttcatcaccaacctttcttagatcactttcttttccagctctatctcataagccacatattcaaatgatctcttatctgtatcattgtcttatgtaaagttctgtgctggctccttggagtactgcaaatcagatttgttttatctctttaggttggtgtctccagtgtatctcctggctaatctttatattctcattacttttcacattattgcttatgaaaaaaatttttctttatttcttatcaagaaagtcctctttcggtgacatttgcatctctgtatcagagatttttaaccttttcttatgctatggacaactttagcagactgggaagcctgagtcattttcccaagaataatgtttactttggattacaagagaaactaattacattgagatccaaatgtgtaaatagtaaagaataactgtattatatagtaatttatgtgcccctttaaaattattaatatattacagtgggtctaacaattatgattttgaaatggtgatgagagtaaacaagattttgtggtatctataatgataccaaattatcattatatgaaaatatatgtgtaatatgaaaatttgcataatttttattggtgacaatgtcacagacactgctaatacctactgcgggtttttgcctacatttgtaatgggatctcaagacccaagaatgaggattctgctttatataattttctctgctggtctagaacatttctctcacccccaaaggaaaatttctgcccactgtagtcatttcccatccttacttccaaccttagggaactactgatctggcttttgcttctgtagatttgtttttttattttgaatacttcatataaatgaaaccatatgatatgtgatcttttgtgtctagctgttttcacttagcataacattttgtctcttccttcattttgcagcatgcaacagtaatttgttcctctttattactgaagagtattccattatatggatatacttttgagtaatgacgctataagcttttgtgtaaacattttgtgtaggcaaatattttcatttattttggggagagacctaggagtagaatttatcagtcttacaaagtttaactaatgttaaagttttaagcaattgttaaaatcttttccaaaataggtgcgcaattttacattccctcatcaatgaggatttcatcttttctacaccttcattaacacacgtgcatgtctgacttttgatttagctttccttgtgtttgtaaagcatgatctcattgtgattttacttcatatttccttgatgtctaatgatgttagcatttttcatgtgctcatttgccatttgtatatcttctttggtaaaatatctatccaagctttctgctcagtttttaattcggttatttgtcatcatcttattaaattgaatgagttatgtattctagctaaagtctcttatcagatatattgcttgcaaatgttttcttctagcctgtagcttgtatttatacttacataagggtatattctgaaacacaaaagttttaaattttgatgacaaactttgcctaaaccaagatcatcagaatttactcctgttttattttttaagttttatttttgcctcttacattaggtctaattttatattatgtcatatactaagtctaattaggtactaatttataaggtcaattttgagtgcactctgaggtatgggtctaattcatttattaattaagaggaattgaaagttatttaaatttcttcttttgccctttaatacatcaaaagtcaggcttagtagtgttggtaaataatattatggggaaatctatacagaaaaatgaatgaagaaactgttaatttattctttagtccctaagggaagtgtggaaacaaaaatagaaaagagacaaaaaatttctgaattatgttctgattctcttttctgtgggccttgtcttactaaggagtacattatgttaatgatcataatttaagctaggagcagacacatgttactcataatcaccgttgggagtgtacgtgcagactcctcattggccactctgtaccaactggcatgcagctacatgagagtaaatttggcaggacagtatgagttgggcagcttgaaagagatggctagattgagtcttcttgagccatattatttccacaaaacatagacacagcaccataggtgatttttttttagcagcatccttcatacacagggtaaggcggtagtataagagccctgcagaataacctggctgagccaaggtttaatagagacatggccatatttgattggtctctgtccaactgatctcagacaggttaagcaaagagatgctactaattctttttctttttgtttttttttgagatggtgtcttcctcgttgcccaggctggagtgcaatggcacgatctcggctccccacaacctccgcctcctgggttcaagcgattctcctgcctcagcctcctgagtagctgggattacaggcatgcaccaccacgctcaggtatttgtatttttagtagagatggggtttcaccacattggccaggttggtcttgaactcccgacctcaggtgatctgcccgtctcggcctcccaaagttctgggattacaggcgtgagccaccgcgtccggtgctactagttcttgtctaagtcaaaagagacaagcttacccgttacatcagctacaatattcagctgaaagggcagcaacaccctaatggacaagagacatcacttcaaagggaggtaaaagcatctacacttgataacttacacattttttaactgccctgagtttactcaggtggtgtgcgcttctcaactaaaccacaccccagtcctcccacttgaaaaatgtcagagaaaaatgagcaagggaatgggtaggccacaggagggtctaaacattttggtatcagcctgaacactgcctaactacactgataaaatgatcagaaaataaatatttaaattggattgatcacgaaaagaattttctcagtaagtagcagggggttaaaaatgatcaattcagctacacacaaaataagtttggcaggcagctctaaagaaactcccaataatccccacttcatcatatccatgctcctgcataattcccttgccttgcacatgagaagaacctaataacttgcttttaagaaatagaacatggctaaagtgatgggatgtcactttcatgattttttttttttaatttggaagttagatttaattaattttttttgcattccaggacttatggaattttttttattattattacactttaagttttaaggtacgtgtccacaatgtgcaggttagttacatatgtatacatgtgccatgctggtgtgctgcacccattaactcgtcatttagcattaggtatatctcctaatgctatccctcccccctcccccctccccccacaccacaacagtccccttccatcaccctttctcttactgacacccttgccctggttccgatgaagccaattaccacattgtgagatgttctgggaaaggaccacatggcaaggaaataagggaggcttctgaccaacagcttgtgaagaattgaaaccttagttacaagtcagctggaacagaatcttaccaaccactatattagtgagttaagaagtggatccttccagtaaagctctgagatgagggcagcattgtgaaaatctcaggcctggaggagccacctaagccacacctagattcttggtccacagaaactgtaagatgataacattgctgttttatgctactaagttctggagtaatttgcaatgcagcaatagaaaactaataatttacattacatatatatatatatatctggaaaagggtgataaatgttttttggtttacaacatataatggtgactagaggtcacaaagggtctgaaaatgtttcccttttcatgtagttgagtgtgaatttgggaaggtacaattgtacttcttctctctagcatcattgaaatgaagcctctttgagcatcacatagttgtatatgtatcacacagagtgtatatatatatacattcgctgaagtttacacacccaggcacctcccccaaaatttctttcagtcattgcacactaaggatactgtggggagtaggaattcatcaaatttaattaaaacttgaaaagcatggtgtttcttatggaatataaggagctaacaaaatatacttaagagtgtttaactgttggttttgaattaacatagtccaacaagcttatttgacaggtgaataacaattattctttttcctggaagaaaagggcattcttgaaaaatcatggaaagctttgattaccaactttccatgactaaacctcaatacaaacccagaagctaagagtaggctggagaaggcaatgccaagttaattattaaatacaaaaatggaaacttgaaagagtttagggaagtggagctgaacctagtagcaaaatcagaattatgcataggagccaagatcaggaaggcactctgaaaggattaggtagcatggaactgagttgctaacaaggaataacttaattttccaaactgtgtgatgctcaaagaggcttcatttcaatgatgctagagagaagaagtacaattgtaccttcccaaattcacattcaactacatgaaaaggaaaacatttttagaccctttgtaagccctagtcagcattatattttgtagaccaaaaaaacatttatttattatcacccttttccagatcttttctatttttaaaattaatttcttcccccacacaggtctcaaatatagtttagacctttagaaagcttgtaaaaactgaaagatcttgtcaactctgaaaacagtgtatatgatagaatatttgctaactacacaaatttcaactctggctgactatattagaaccatatccctgccacttaccagatgtgtgaccttgaacatgtcatttaacttatctgaacctgtctcctcatctgaaaaatggatatgataatattagttaccaatataggataattgtgaagtttaaatgagtaaacatgtataaagagctcataataatatatggcaccaaataagttaaagataattatgaattgtattaatcatattattattattactttttattttattattattatactttaagttttagggtacatgtgcacaatgtgtaggtttgttacatatgtatacatgtgccatgttggtgtgctgcacccactaactcgtcatttagcattaggtatatctcctactgctatccctcccccctcccctgaccccacaacagtccccagagtgtgatgttccccttcctgtgtccatgtgttctcattgttcaattcccaatgatgagtgagaacatgcgctgtttggttttttgtccttgcaatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctactgtgaatagtgctgcaataaacatacgtatgcatgtgtctttatagcagcatgatttataatcctttgggtatatacccagtaatgggattgctgggtcaaatggtatttctagttctagatccctgaggaattgccacactgacttctacaatggttgaactagtttacagtcccaccaacagtgtaaaagtgttcctatttctccacatcctctccagcatccattgtttcctgactttttaatgatcgccattctaactggtgtgagatggtatctcattgtggttttgatttgcatttccctgatggccagtgatggtgagcattttttcacatgttttttggctacataaatgtcttattttgagaagtgtctgttcatatcctttacccactttttgatggagttgtttgtttttttcttgtaaatttgtttgagttcattgtagattctggatattagccctttgtcagatgagtaggttgcaaaaattttctcccatgttgtaggttgcctgttcactctgatggtagtttcttttactgtgcagaagctctttagtttaattagatcccatttgtcaattttggcttttgttgccattgcttttggtgttttagacatgaagtccttgcccatgcttatgtcctgaatggtaatgcctaggttttcttctagggtttttatggttttaggtctaacatttaagtctttaatccatcttgaattaatttttgtatgaggtgtaaggaagggatccagattcagctttctacatatggctagtcagttttcccagcaccactgattaaatagggaatcttttccccacttcttgtttttgtcaggtttgtcaaagatcagatagttgtagatatgtggcattatttctgagggctctgttctgttccattgatctatatctctgttttggtaccagtaccatgctgttttgattactgtagccttttaatatagtttgaagtcagttagcatgatgcctccagctttgttcttttggcttaggattgacttggcgatgcgggctcctttttggttccatatgaactttaaagtagtttttttcaattctgtgatgaaagtcattggtagcttgatggggatggcattagatctataaattaccttgggcagtgtggccattttcacgatattgattcttcctacccatgagcatggaatgttcttccatttgtttgtatcctcttttatttccttgagcagtggtttgtagttctccttgaagaggtccttcacatcccttgtaagttggattcctaggtatttcattctctttgaagcaattgtgaatgggagttcactcatgatttggctctctgtttgtctgttattggtgtataagaatgcttgtgatttttgtacattgattttgtatcctgagaatttgctgaagttgcttaccagcttcaggaaattttgggctgagacaatggggttttctagatatacaatcatgtcatctgcaaacagggacaatttgacttcctcttttcctaattgaatgccctttatttccttctcctgcctaattgccctggccagaacttccaacactgtgttgaataggagtggtgagagaaggcatccctgtcttgtgccagttttcaaagggaatgcttccagtttttgcccattcagtatgatattggctgtgggtttgtcatagatagctcttattattttgagatatgtcccatcaatacctaatttattgagagtttttagcacgaagcattgttgaattttgtcaaaggccttttctgcatctattgagataatcatgtggcttttgtctttggttctgtttatatgctggattacatttattgatttgcgtatgttgaaccagccttgcatcccagggatgaagcccacttgatcatggtggataagctttttgatgttctgctggattcggtttgccagtattttattgaggatttttgcatcaatgttcatcaaggatattggtctaaaattctcttttttggttgtgtttctgccccccggctttggtatcaggatgatgctggcctcataaaatgagttagggaggattccctctttttctattgattggaatagtttcagaaggaatggtaccagctcctccttttacctctggtagaattcggctgtgaatccatctggtcctggactttttttggttggtaagctattgattattgccacaatttcagatcctgttattggtctatgcagagattcaacttcttcctggtttagtcttgggagggtgttatgtgtcgaggaatttatccacttcttctagattttctagtttatttccttagaggtgtttgtagtattctctgatggtagtttgtatttctgtgggatcagtggtgatatcccctttatcattttttattgcatctatttgattcttctctcttttcttctttattagtcttgctagcagtctatcgattttgttgatcttttcaaaaaagcagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaacaacatctttacttctgccttcatttcgttatgtacccagtagtcattcaggagcagattgttcagtttccacacagttgagcagttttgagtgagtttcttaatcctgagttctagtttgattgcactgtggtctgagagacagtttgttataatttttgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttaactttctgtttcattgatctgtctaatgttgacagtggggtgttaaagtctctcattattattgtgtgggagtctaagcctctttgtaggtcactaaggacttgctttatgaatctgggtgctcctgtattgggtgcatatatattgaggatagttagctcttcttgttgaattgatccctttaccattatgtaatggcctctttgtctcatttgatctttgttggtttaaagtctgttttatcagagactaggattgcaacccctgccttttttttgttttccatttgcttggtagatcttcctccatccctttattgtgagcctatatgtgtctctgcatgtgagatgggtttcctgaatacagcaaactgatgggtcttgactctttatccaatttgccagtctgtgtcttttaattggagcatttagtccatttacatttaaagttaatattgttatgtgtgtatttggttctgtcattatgaggttagctggttattttgctcgttagttgatgcagtttcttcctagccttgatggtctttacattttggcatgtttttgcagtggctggtaccagttgttcctttccatgtttagtgcttccttcaggagctcttttagggcaagccttgtggtgacaaaatctctcagcatttgcttgtctgtaaagtattttatttctccttcacttatgaagcttagtttggctggatatgaaattctgggttgaaatttcttttctttaagaatgttgaatattggtccccactctcttcttgcttgtagagtttctgctgagagatcagctgttagtctgatgggcttccctttgttggtaacgcgacctttctctctggctgcccttaacattttttccttcatttcaacttgggtgaatctgacaattatgtgtcttggagttgatcttcttgaggagtatctttgtggcgttctctgtatttcctgaatttgaatgttggcctgccttgctagattggggaagttctcctggataatatcctggagagtgttttccaacttggttccattctctccatcattttcatgtacaccaatcagatgtagatttggtcttttcacatagtcccatatttcttggaggctttgctcatttctttttattgttttttctctaaacttcccttctcgcttcatttcattcatttcatcttccatcactgataccctttcttccttttgatcgcattggctcctgaggcttctgcattcttcacatagttcttgagccttggctttcagctccatcagctcctttaaggacttctctgcattggttattctagttatccattcgtctaattttttttttcaaagtttttaacttctttgccattggtttgaatttcctcctgtagctcagagtagtttgatcgtctgaagccttcttctctcagctcgtcaaagtcattttccgtccagctttgttccgttgctggtgaggagctgtgttcctttggaggaggaggggtgctctgctttttagagtttccagtttttctgctcttttttttccccatctctgtggttttatctacttttggtctttgatgatggtgatgtacagaagggtttttggtgtggatgtcctttctgtttgttagttttccttctaacagacaggatcctcagcttcaggtctgttggagtttgctagaggtcaacttcagaccctgtttgcctgggtatcagcgtggtggctgtagaacagcggatcttggtgaaccgcaaatgctgctgcctgatcattcctctggaagttttgtctcagaggagtacccggctgtgtgaagtgtcagtctgcccttactggggggttcctcccagttaggctgctcaggggtcaagg

SEQ ID NO: 12582 - DNA, 5602 bp, Homo sapiens
tttttttttcttttttatacgttaagttttagggtacatgtgcacaacgtgctggttagttacatatgtatacatgtgccatgttggtgtgctgcagtcattaactcgtcatttaacattaggtgtatctcctaatgctatccctccccactccccaagccacacaacaggccccggtgtgtgatgttccccttcctgtgtccatgtgttctcattgttcaattcccacctatgagtgagaacgtgtggtgtttggttttttgtcgttgcgatagtttgctgagaatgatggtttccagcttcatccatgtccctacaaaggacatgaactcatcatcttttatgactgcatagtattccacggtgtatatgtgccacattttcttaatccagtctatcattgttggacatttgggttggttccaagtctttgctatggtgaatagtgccacaataaacatacgtgtacatgtgtctttatagcagcatgatttatagtcctttgggtatatacccagtaatgggattgttgggtccaatggtatttctagttctagatccctgaggaattgccacactgacttccacaatggtggaactagtttatagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgcctgttcatatccttctcccactttttgatggggttgtttgttttttccttgtaaatttatttgagttctttatagattctggatattagccctttgtcagatgagtagattgcaaaaattttctcccattttgtgggttgcctgttcactctgatggtagtttcttttgctgtgcagaagctcttgagtttaattagatcccatttgtcaattttggcttttgttgccattgcttttggtgttttagatatgaagtccttgcccatgcctatgtcctgaatggtattgcctaggttttcttctagggtttttatggttttaggtgtaacatttaagtctttaatccatcttgaattaatttttgtataaggtgtaaggaagggatccagtttcagctttctaaatatggctagccagttttcccagcaccatttattaaatagggaatcgtttccccatttcttatttttgtcatgtttgtcaaagatcagatgggtgtagatatgtggcattatttctgagggctctgttctgttccattggtctatatctctgttttggtaccagtactatgctgttttggttactgtagccttgtagtatagtttgaagtcaggtagtgtgatgcctccagctttgttcttttggcttaggattgacttggcaatgtgggcccttttttggttccatatgaactttaaagtagttttttccaattctatgaagaaagttcttggtagcctgatggggatggcattgaatctataaattaccttgggcagtatggccattttcatgatattgattcttcctacccatgagcatggaatgttcttccatttgtttgtatcctcttttatttcattgagcagtggtttatagttctccttgaagaggtctttcacatcccttgtaagctggattcctaggtattttattctgtttgaagccattgtgaatgggagttcactcatgatttggctctctgtttgtctgttattggtgtataagaatgcttgtgatttttgcacattgattttgtatcctgagactttgctgaagttggctgtcagcttaaggagattttgggctgagacgatggggttttctagatatacaatcatgtcatctgcaaacagggacaatttgacttcctcttttcctaattgaatgccctttatttccttctcctgcctgattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagttttagcgtgacgcattgttgaattgtgtcaaaggccttttctgcatctcttgagagaatcatatggtttttgtctttggttctgtttatatgctggattatgtttattgatttgtgtatgttgaaccagccttgcatcccagggatgaagctgacttgatcatggtggataagctttttgatgtgctgctggattcggtttgccagtattttattgaggatttttgcatcgatgttcaccagggatattggtctaaaattttctttttttgctgtgtctctgccaggctttggtagcaggatgatgctggcttcataaaatgagttagggaggattctctctttttctattgattggaacagtttcagaaggaatgttaccagctcctccttgtacctctggtagaatttggctgtgaatccatctggtcctggacttttttggttggtaagttattaattattgcctcaatttcagagcctgttattggtctattcagagattcaacttcttcctggtttagtcttgggagggtgtatgtgtcaaagaatttatccatttcttctagattttctagtttatttgtgtagaggtgttgatagtattctctgatggtagtttgtatttctgtgggatcgggggtgatatcccctttatcattttttattgcatctatttgattcttctctcctttcttctttattagtcttgttagtggtctatcaattttgttgatcttttcaaaaaatcagctgctggattcattgatttttttgaagagttttttgtgtctctgtttccttcagttctgctctgatcttagttatttcttgtcttctgctagcttttgaatgtgtttgctcttgcttctctagttcttttaattgcgatgttagggtgtccattttagatctttcctgcttttccttgtgggcatttagtgctataaatttctctctacacactgctttgaatgtgtcccagagattctggtatgttgtgtctttgttctcgttggtttcaaagaacatctttatttctgccttcatttcattatgtacccaatagtcgttcaggagcaggttgttcagtttccatgtagttgagtggttttgagtgagtttcttaatcctgagttctagtttgattgcactgtggtctgagagacagtttgttataatttcttttcttttacatttgctgaggagtgctttacttccaactatgtggtgcattttggagtaagtgcggtgtggtgctgagaataatgtatattctgttgatttggggtggagagttctgtagatgtctattaggtctgcttggtgcagagctgagttcaattcctggatatcctttttaactttctgtctcgtggatctgtctaatgttgacagtgaggtgttaaagtctcccattattattgtgtgggagtctaagtctctttctaggtctctaaggacttactttatgaatctgggtgctcctgtattggttgaatatatatttaggatagttagctcttcttgttgaattgatccctttaccattatgtaatgaccttctttgtctcttttgatctttgttgttttcaagtctgttttatcagagactaggattgcaacccctgcctttttttgttttccatttgcttggtagatcttcctccatccctttatttgagcctatgtgtgtctctgcacgtgagatgggtttcctgaatacagcacactgatgggtcttgactctttatccaatttgccagtctgtgtcttttaattggagcatttagcccatttacatttaaggctaatattgttatgtgtgaatttgatcctgtcattatgatgttagctggttattttgctcattagttgatgcggtttcggtctttacaatttgtcacatttttgcagtggctggtaccggttgttcctttctatgtttactgcttccttcagaagctcttttagggcaggcctggtggtgacaaaatctcttagcatttgcttgtctgttaaggattttatttctccttcacttatgaagcttagtttggctgcatatgaaattctgagttgaaaattcttttctttaagaatgttgaatattggcccccactctcttctggcttatagagcttctgctgagagatcagctgttagtctgatgggcttccctttttgggtaacccgacctttctctctggctgcccttaacattttttccttcatttcaactttggtgaatctgacaattgtgtgtcttggagttgctcttctggaggagtatcttggtggtgttctctgtatttcctgaatttgaatgttggcctgccttgctagattggggaagttctcctggataatatcctgcagagtgtcattctccctgtcactttcagctacaccaatcagaagtagatttggtcttttcacatagtcccatatttcttggaggctttgttcatttctttttattctttttttctctaaacttctcttctcgcttcatttcattcatttaatcttccatcactgataccctttcttccagttgatcgaatcggctactgaggcttctgcattcatcacgtagttctcatgccttggttttcagctccatcaggtcctttaaggacttctctgcattggttattctagttagccatttgtctaattttttttcaaggtttttaacttctttgccatgggtttgaacttcctcctttaggtcagagtagtttgatcatctgaagccttcttctctcaactcgtcaaagtcattctccgtccagctttgttccactgctgttgaggagctgcgttcctttggaggaggagaggtgctctgatttttagagtttccaatttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacagcggatattggtgagcagtaaatgttgctgcctgatcgttcctctggaagttttttctcagaggagtacctggctgtgtgaggtgtcagtctgcccctactggggggtgcctcccagttaggcttgggggtcagggacccacttgaggcagtctgtcagttctcagatctccagctgcatgctgggagaaccactactctcttcaaagctgtcagacagggacgtttaagtctgcagaggtttctgctgccttttgtttggctatgccctgcccccagaggtggagtctacagaggcaggcaggcctccttgagc

SEQ ID NO: 12583 - DNA, 11525 bp, Homo sapiens
ttcttttttttttctttctttttttttttttttttttttttttgagacggagtctcgctctgtcgcccaggctggagtgcactggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagatggatattctaaaagcaatagagtctatcagcactctgttcaagacttccagatggatcgtattatcctttgaataaaatcttatgttttataaaaatgattctcaaacattttaatctcagaatccctttcactctgaaaaattattgaggaagggctccaaagagcttttgtttacgtgggctatatctgtaaatatgtaatttatttaaaattataactaagaatatgtaaacatatttatttgttaaatatttttaaaacaacaataaaaacctattatatgttaatgtaaatgacatattttttatatattgggcaatagagtgagaccctgtctcaaatatatatatatttgagcacccatatatatatgggtgctgttgcccaatctagactgcagtggcatgatcatggctcactgcaacctctgcctcctgggctcaggtgatcctcccacctcagcctcctgagtagctgggactataggtgtgcaccaccacacccagttaattaaacaattttttttgtggaggtgggttttgccatgttgaccaggctgctctcaaactcctgggctcaagtgatctgcctgtcttggcctcccaaaatgccgtgattacaggtgtgagccactgcacctggcgtgaaaaaatatatattttcaaaaacaaaaataatacagtgaggagaatgacattgttttacatttttgcaaatctcttgaatatttggtttaataaaagacagctggattttcatattttcttctgcattcaatctgttgcaatatattgttttgattgaactatatgaagaaaattcaacctggtagaaaaaagtatttgggaaaaggaggaccttatggaacccctgaggatatcagggatccctctggttccccagacgacacgttgaaacagctaacctacaaagttcaacatgatctggcccctacctgtctcttggactttatctgtaaccatctctactttctcactctctgttctagctctgttctaacctcctgccagtccttggactcttcaagcaggttcccaccccaaagcctttggtccctgtgcctggaaactctctagtcttgttcttggatccttccttcacctcatacaggtggcaggttagattttatttcacagagaaatttgttggattactttttgaaaataacacctatatcctctcttattctatttttctctgtcactttaccctgctttattttcataaaacttacaaactggatttgattattacattgtatgtcttctgtactagaatttaaactctatgaggtcaagaccttttttttccttgtatgccattgcatttccacacctgagaagtaattttcacaagaaatatttcttgaatgtattaattaataaataagaaaatcaccaatcagcattgagtctcaaaccagatgacttttctcgcatctttagataatgattttaaaaactgggctttgttgagagaaagagaaatttctatgtgatagagctcctcctttgacatatcagaatggatcatagagctttaatcttgagaagtttgaaagtgtgcttttttcctggtctcggagattgtgggaagaggaagggggatgtaggtagggaagatgtgtggctaaatagctgggttatgagttctccctgccactgactttccacaacttgagaatatgttaggtattttcagggatatggtgagagcagactttgttccaggtaacatctgcgacccctaacagtgaatgcttctcaagctgcatcagagtaatggtgtctataagcacagttagtgagagaaaagattcctaactctgatctgtcttggttcctgtgagacatggaatatggaattgggacatggaagttggttgaaagcataactcagaagtagaccagggtgggctatggcagtacaatgaagtgacagcaagtccagactgcagggtggactgcctcagccagcaaccaaataggaatcaaaaccacaatgcaggggcctgtagctataatggggacaaagtcacagagaggaccaccatcccaaatcaagcccaaagccaatggtgcatcagctacaggcactgggagaagcaagcagccaagggagggacatcattgtgcataccaaagtggacagagggcagttcaaggggctgagtaaatacccaatttccaccattccctcttcctgagatcaataaggccttctacctgctgtatacctggatgacaccttggagtgtcagcagagacagggcagaaaatcagagtatttgcccaaaatagcctaaaaggtttttattgcagaaattaatgaagtgtccttagcttactgcatggagtaaatatagacagggaaagcctggaggtctagttcatgaaactctctgctatttcatctcctacctctggaaggtcaaccgttgtgttggagctcgccattgtcattttaatctttggcatgaaatgacatttgacaaaagaagaaacaccagtgggtaataaacatacacatagaatcactttttattatttttacaaaatcactttattacttttataataataaagacaaactaaagaaacaataaggtacctgataaagggccttttatattggcaaatatctgttgaattatattatccaatatagaaaatatgacagtgaaatagacactcatactctgttagtgatgacacatttctggaggataatttgtcaatattcatctacttctagcgattaatctatgaatactggcagggatagttagtgaccatcaactaactaatcaatttcttattttatgcactgtgtttttgctgttataccctagaaatctttgtatagcccaaatcacaaaaattttctccagtttttaaaaagttatatacttttaggttttacagtttatcatccattttgaagtaatttttgtatatggtgcaaggaataattaaaagttcatttgaagactttttttgcatgtggttagtcagttgtgccagcactccttgctgaatagattatcatttctccactggattgcctttgcaactttgtcaaaaatcaattgattacatgtgtgggtctatttctggactttttattctgtttcattgattttttaaatctattttgatgctaataccacattgccttgattactatagacttataataaatctggaaatcaaatagttaaagtttttgactttgctattctttttcaaagttgttttggctattcaaagtcctttgtattttcatatgaattttagaattagcttgttgatttctacaaaacaagctcgctaagactttgcttggcattgcattaattttatagttcaatttgggaagaactgaaaccttaacaatattcaatcttcctattcatgaacagggaatatctctccatttatttacatctttattttttgatcagtactattttatagttttcagagtacagatcttttacttgtcatagttatctctaaatattctcttcatgctaaggggaacggcattattttttaagaatttcactttaatagtgttcatcactagtgtatagaaatgcaattgactttggtacattggtcttgtatcttgcaaccttgctaaactcacatagtagctataccgtagtccccccttattcttcactttgtatggtttcagttacctaaggtcaactgtggttcaaaaatggaaaattacagaaataaagagtttatgaattttgaagtgtgcgctgttctgagtagtgtgataaaatctcttgccatcccactccattctgctcagaagttgaatcattcctttgtccaaatgtattcgctccttacttattagtcacttagtaaccatctcatttacaagatcaactgttgtggtatttcagtagtatcacagttcaagtaacccttattttacttaattgttctattttaacattagctgttgttaatctcttactgtgactaatttataaattaaattttatcttaggtatgtttacactggaaaaaggtagcgtacatgtagtatatatagttcggtaccatctgaggtttcagacatccactggaggtcttaaaatttacccccctgaagatttaaaaaaaaaaaaaaaagaaaagaaaaacaactgtcatggcatttttgtttattctataaaattttctccaaggacagtcatgtctgtaaaaataatttaaattatttcttcataaactgagctaaataatacctcaagctacataagctaaatactacctcagctgcctccaacaaattttgtatgctgtcctttcattctcattcagttcaaaataccttctaattttctttttgatttcttgtttataacatggggtatttagaagtgtgttatttaactttcagatatttgaagattttccagatatgtttctgttgcttattttagaaatttaattctgttgtaaacagagaacacacatcatacaatttgagtaatttaaaatctattgagacttgttatatggcccagaatatatcttggtaaatgttctgtatgcacttgaaaaaaacgtctattctgttgatgataggtgcagtattatacaaatgtcaattagataaaattggtttgtagtgttgttcgaatctttagctgtaattgtggatttctctatccttgattttttttcaagtattttggaactctattattagtgtgtaattatttaggattgtattctcttaaactaaccacttaactaatatgaaatgaccctctttatctcaggtaataatctgtgctctgaaatctactttgatattaatatagcctctccagctatcttttgactatgttaacatggtgtatcttttcccatctttttactgttaagctatttgtgtctctatatttaaagcgtgtttcttttaggcagcatatacttgcatttttctgttttaatccaatctgaaatctctgcctttcatttttaattattattattattatgatactttaagttttagggtacatgtgcacaatgtgcaggtttgttacatatgtatacatgtgccatgttgatgtgctacacccattaactcgtcatttagcattaggtatatctcctaatgccatccctcccccctccccccaccccacaactttccctggagtgtgatgttccccttcctgtgtccatgtgtcctcattgttcaattcccacctatgagtgagaacatgcggtgtttggttttttgtccttgcaatagtttgctgagaatgatgattttaaatttcatgcatgtccctacaaaggacatgaactcatcattttttatggctgcatagtattccatggtgtatatgtgccacattttcttaatccagtctatcgttgttggacatttgggttggttccaagtctttgctattgtgaatagtgcctcaataaacataagtgtgcatgtgtctttatagcagcatgatttatagtcctttgagtatatatgcagtaatgggatggctgggtcaaatggtatttctagttctagatccctgaggaatcgccacactgacttccacaatggttgaactatattacagtcccaccaacagtgtaaaagtgttcctatttctacacatcctctccagcacctgttgtttcctgactttttaatgattgccattctaactggtgtgagatggtatctcactgtggttttgatttgcatttctctgatggccagtgatgacgagcattttttcatgtgttttttggctgcataaatgtcttcttttgagaagtgtctgttcatatcctttgcccactttttgacagggttgtttgtttttttcttgtaaatttgtttgagttcattgtagcttctggatattagccctttgtcagattagtaagttgtgaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctgtgtcctgaatggtattgcctaggttttcttctagggtttttatggttttaggtctaacatttcagtctttaatccatcttgaattaatttttgtataaggtataaggaagggatccagtttcagctttctacatatggctagccagttttcccagcaccatttattaaatagggaatcctttccccgttgcttgtttttctcaggtttgtcaaagatcaggtagttgtagatatgcggcattatttctgtgggctctgttctgttccattgatctatatctctgttttggtaccagtaccatgctgttttggttactgtagccttgtagtatagtttgaagtcaggtagcatgatacctctggcttttttcttttggcttaggattgacctggtgatgtgggctcttttttggttccatatgaactttaaagtagttttttccaattctgtgaagaaagtcattggtagcttgatgggagtgtcattgaatctataaattaccttggacagtatgaccattttcacgatattgattcttccaacccatgagcatgggatgtttttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagaatttgctgaagttgcttatcagcttgaggagattttggcctgagacgatggggttttctagatatacaatcatgtcatctgcaaacagggacaatttgactccctcttttcctaattgaataccctttatttccttctcctgcctgattgccctggccagaacttccaacactatgttgaataggagtggtgagagagggcatccttgtcttgtgccagttttcaaagggaatgcttccagtttttgcccattcagtatgatattggctgtgggtttgtcataaatagctcttattattttgagatatgtcccatcaatacctaatttattgagagtttttagcatgaagagttgttgaattttgtcaaaggccttttctgcatctattgagataatcatgtggtttttgtctttggttctgttatatgctggattacatttattgatttgcgtatgttgaaccagccttgcatcccagggatgaagcccacttgatcatggtgaataagctttttgatgtgctgctggatttggtttgccagtattttattgaggatttttgcatcaaggttcatcaaggatattggtctaaaattctgtttttttgttgtgtctctgccaggctttgctatgaggatgatgctggcctcatagaatgagttagggaggattccctctttttctattgattggaatagtttcagaaggaatggtaccagctcctccttgtacctctggtagaattcggctgtgaatccgtctggtcctggactctttttggttggtaaactattgattattgcttcaatttcagagcctgttattggtctattcagagattcaacttcttcctggtttagtcttgggagggtgtatgtgtcgaggaatttatccatttcttctagattttctagtttatttgcatagaggtgtttgtagtattctctgacggtagtttgtatttctgtgggattggtgtgatatctgctttatcattttttattgtgtctatttgattcttctctcttttcttctttattagtcttgctagcggtctatcaattttgttgatcttttcaagaaaccagctcctggattcattaattttttgaacggttttttgtgtctctatttccttcagttctgctctgattttagttatttcttgccttctgctagcttttgaatgtgtttgctcttgcttttctagttcttttaattgtgatgttagggtgtcaattttggatatttcctgctgtctcttgtgggcatttagtgctataaatttccctctacacactgctttgaacgtgtcccagatattctggtatgttgtgtctttgttctcgttggtttcaaagaacatctttatttctgccttcatttcattatgtacccagtagtcattcaggagcaggttgttcagtttccatgtagttgcgtggttttgagtgagtttcttaatcctgagttctagtttgattgcactgtggtctgagagacagtttgttataatttctgttcttttacatttgctgaagagtgctttaattccaactatgtggtcaattttggaataggtgtggtgtggtgctgaaaaaaatgtatattctattgatttgggatggagagttctgtagatgtctattaggtctgcttggtgcagagctgagttcaattcctgggtatccttgttaactttctgtctcgttgatctgtctaatgttgacagtggggtgttaaagtctaccattattaatgtgtgggagtctaagtctctttgtaggtcactcaggacttgctttatgaatctgggtgctcctgttttgggtgcatatatatttaggatagttagcccttcttgttgaattgatccctttaccattatgtaatggcctctttgtctcttttgatctttgttagtttaaagtctgttttatcagaaactaggattgcaacccctgcctttttttgttttccatttgcttggtagatcttcctccatccctgtattttgagcccatgtgtgtctctgcatgtgagatgggtttcctgaatacaacacactgatgggtcttgactctttatccaattccccagtctatgtcttttagttggagcatttagcccatttacatttaaagttaatattgttatgtgtgaatttgatcctgtcattatgatgttagctggctattttgctcgttagttgatgcagtttcttcctagccttgatggcctttacaatttgacatgtttttgcagtggctggtactggttgttcctttccatgtttagtgcttccttcaggagctcttttagggcaggcctggtgttgacaaaatctctcagcatttgcttgtctgtaaagtattttatttctccttcatttatgaagcttagtttgggtggatatgaaattctggattgaaaattcttttctttaagaatgttgaatattggcctccactctcttctggcttgtagagtttctgccgagagatcagctgttagtctgatgggcttccatttgtgggtaacacaacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtgttttccaccttggttccattctccccatcactttcaggtacaccaatcagacgtagatttggtcttttcacatagccccatatttcttggagactttgttcatttctttttattcttttttctctaaacttcccttctcgcttcatttcattcatttcatcttccatcactgataccctttcttccagttgatcgcatcggctcctgaggcctctgcattcttcacgtagttctcgagccttggctttcagctccatcagctcctttaagcacttctctgcattggttattctagttattcatttgtctaattttttttcaaagtttttaacttttttgccattggtttgaatttcctcctgtagcttggagtagtttgatcgtctgaagccttcttctctcaactaatcaaagtcactctccatccagctttgttccattgctggtgaggaactgcattcctttggagtaggagaggtgctctgatttttggagtttccagtttttctgctctgttttttccccatctttgtggttttatctagtttttgtctctgatgatggtgatgtacagatgggtttttggtgtagatgtcctttctgtttgttagttttccttctaacagtcaggaccctcagctgcaggtctgttggagtttgctagaggtccactccagaccctatttgcctgggtatcagcagcagtggctgcaaaacagcgatggctgtagaacagcagattttcatgaaccgcaaatgctgctatcaggaagttttgtctcagaggggtacctggccgtgtgaggtgtcagtctgcccctactggggggtgcctcccagttaggcagctcgggggtcagggacccacttcaggaggcagtctgcccgttctcagatctccagcttcgtgctgggagaaccactactctcctcagagctgtcagacagagacatttaagtctgtagaggttactgctgtctttttgtttgtctgtgccctgcccccagaggtggagcctacagaggcaggcaggcctccttgagctgtgctgggctccacccagtttgagcttccccccgctttgtttacctaagcacgcctgggcaatggcaggtgcccctcccccagcctcgctgctgccttgcagtttgatctcagactgctgtgctagcaatcagggagactctgtgggcgtaggaccctctgagccatgtgcgggatataatctcctggtgtgccatttgttaagcctattggaaaagcacagtattagggtgggagtgacctgattttccaggtgccgtcttgtcacccctttctttgactaggaaagggaactccctgaccccttgcacttcccgagtgaggcattgcctcactctgtttcagctcatgcacggtgcgctgcacccactgtcctgcacccactgtctggcactccctagtgagatgaacctggtacctcagatggaaatgcagaaatcacccatcttctgtgtcgctcacgctgggagctgtagactggagctgttcctattcggccatcttggctccacc

SEQ ID NO: 12584 - DNA, 6070 bp, Homo sapiens
agaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttt

SEQ ID NO: 12585 - DNA, 10827 bp, Homo sapiens
tttaaattttttttattatgctttaagttttagggtacatgtgcacattgtgcatgttagttacatatgtatacatgtgccatgctggtgcgctgcacccactaactcatcatctagcattaggtatatctcccaatgctatccctcccccctcccccctccccccaccccaccacagtccccagagtgtgatattccccttcctgtgtccatgtgatctcattgttcaattcccacctatgagtgagaatatgcggtgtttggttttttgttcttgtgatagtttactcagaatgatgacttccaatttcatccatgtccctacaaaggacatgaacccatcattttttatggctgcatagtattccacggtgtatatgtgtcacattttcttaatccagtctatcattgttggacatttgggttggttccaagtctttgctattgtgaataatgccgcaataaacatatgtgtgcatgtgtctttatagcagcacgatttatagtcctttgggtatatacccagtaatgggatggctgggtcaaatggtatttctagttctagatccctgaggaatcgccacactgacttccacaatggttgaactagtttacggttccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggggttgtttgtttttttcttgtaaatttgtttgagttcattgtagattctggatattagccctttctcagatgagtaggttgcgaaaattttctcccattttgtaggttgtctgttcactctgatggtagtttcttttgctgtgcagaagctctttagtttaattagatcccatttgtcaattctggcttttgctgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaacatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcggtgtgggctcttttttggttccatatgaactttaaagtagttttttccaattctgtgaagaaagtcattggtagcttgatggggatggcattcaatctgtaaattgccttgggcagtatggccattatcacgattttgattcttcctacccatgagcatggaatgttcttccatttgtttgtatcctcttttatttccttgaggagtggtttgtagttctcctcgaagaggtccttcacatcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttcccctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcagtacctaatttattgagagtttttagcatgaacggttgttgaattttgtcaaaggctttttctgcatctattgagataatcatgtggtttttgtctttggctctgtttatatgatggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcagaatgatgctggcctcataaaatgagttacagaggattccctctttttctattgattggaatagtttcagaaggaatggtaccagttcctccttgtacctctggtagaattcggctgtgaatccatctggtcctggactctttttggttggtaaactattaattattgccacaatttcagctcctgttattggtctattcagagattcaacttcttcctggtttagtcttgggagagtgtatatgtcgaggaatttatccatttcttctagattttctagtttatttgcgtagaggtgtttgtagtattctctgatgttagttcgtatttctgagggatcggtggtgatatcccctttatcattttttattgcgtctatttgattcttctctctttttttctttattagtcttgctagcagtctatcaatcttgttgatcctttcaaaaaaccagctcctgggttcattaattttttgaagggttttttgtgtctctatttccttcagttctgctctgattttagttatttcttgctttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtacattgtgtctttgttctcgttggtttcaaagaacatctttatttctgccttcatttcgttatgtatccagtagtcattcaggagcaggttgttcagtttccatgtagttgagcggttttgagtgagcttctgaatcctgagttctagtttgattgcactgtggtctgagagatagtttgttataatctctgttcttttacatttgctgaggagagctttacttccatgtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgtttatctgtctaatgttgacagtggggtgttaaagtctcccattattaatatgtgggaatctaagtctctttgcagttcacccaggacttgctttatgattctgggtgctcctgtgttgggtgcatatatatttaggatagttagctcttcttgttgaattgatccctttaccattatgtaatggccttctttgtctcttttgatctttgttggtttaaagtctcttttatcagagactaggattgcaacccctgcctttttttgttttccatttgcttggtagatcttcctccatccttttattttgagcctatgtgtgtctctgcacgtgagatgggtttcctgaatacggcacactgatgggtcttgactctttatccaatttgccagtctgtgtcttttaattggagcatttagtgcatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctgtcttgtagggtttctgccaagagattcgctgttagtctgaggggcttccctttgagggtaacctgacctttctctctggctgcccttaacgttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatgagatgtagatttggtcttttcacataatcccatacttcttggaggctttgctcatttcttcttatgcttttttctctaaacttcccttctcgcttcatttcattcatttcatcttccattgctgataccctttcttccagttgatcgcatcggctcctgaggcttctgcattcctcacgtagttcttgagctttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttcccttgctggtgaggaactgcgttcctttggaggaggagaggtgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaacctcagctgcaggtctgttggaataccctgccgtgtgaggtgtcagtgtgcccctgctggagggtgcctcccagttaggctgctcaggggtcaggggtcagggacccacttgaggaggcagtctgccggttctcagatctccagctgcatgctgggagaacaactgctctcttcaaactgtcagacagggacatttaagtctgcagaggttactgctgtctttttgtttgtctgtgccctgcccccagaggtggagcctacagaggcaggcaggcctacttgagctgtggtgggctccacccagttagagcttccaggctgctttgtttacctaagcaagcccgggcaatggcgggcgcccctccccaagcctcgctgccgccttgcagtttgatctcaaactgctgtgctagcaatcagcgagactccgtgggcataggaccctctgagccaggtgcggggtataatctcgtggtgcgccattttttaagccggtccgaaaagcgcaatattcaggtgggagtgacccgattttccaggtgagtccgtcacccctttctttgactcggaaagggaaccccctgaccccttatgcttcgcgagtgaggcaatgcctcgccctgcttcggctcgcgcacggtgcgtgcacccactgacctgtgcacactgtctggcactccctagtgagatgaacccggtacctcagatggaaatgcagaaatcacccgtcttctgcgtcgctcaccttgggagctgtagaccggagctgttctagaaatttctttaaaaactaaaaatattgctataaatttccctctacacactgcttttaatgcgtcccagagattctggtatgttgtgtcgttttcgttggtttcaaaggacatctttatttctgccttcattttgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaactatgtagtcaattttggaatagatgtggtgtggtgctgaaaaaatgtatattctgttgatttggggtagagagttctgtagatgtctattaggtccgcttggtgcagagctgagttcaatttctgggtatccttgttgactttctgtctcgtttatctgtctaatgttgacagtggggtgttaaagtctcccattattaatatgtgggagtctaagtctctttgcagttcacccaggacttgctttatgaatctgggtgctcctgtgttgggtgcatatatatttaggatagttagctcttcttgttgaattgatccctttaccattatgtaatggccttctttgtctcttttgatctttgttggtttaaagtctcttttatcagagactaggattgcaacccctgccttttttttgttttccatttgcttggtagatcttcctccatccttttattttgagcctatgtgtgtctctgcacgtgagatgggtttcctgaatacggcacactgatgggtcttgactctttatccaatttgccagtctgtgtcttttaattggagcatttagtgcatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttttaggacaggtctggtggtgacaaaatctctcagcatttgcttgtctgtaaaggattttatttctccttcacgtatgaagcttagtttggctggatatgaaattctgggttgaaaattcttttctttaagaatgttgaatattggcccccactctcttctgtcttgtagagtttctgctgagagatctactgttagtctgaggggcttccctttgagggtaacctgacctttctctctggctacccttaacattttttccttcatttcaactttggtgaatctgacaattatgtgtcttggagttgctcttctcgaggagcacctttgtggcgttctctgtatttcctgaatctgaatgtttgcctgtcttgctagattggggaagttctcctggataatatcctgcagagtgttttccaacttggttccattctctccatcacattcaggtacaccgatcagacgtagatttggtcttttcacatagtcccacatttcttggaggctttgctcgtttctttttcttcttttttctctaaacttcccttcttgcttcatttcattcatttcatcttcgatcactgataccctttctaaatacccacaagagaaagcaggaaagatccaaaattgacaccctaacatcacaattaaaagaactagaaaagcaagagcagacacattcaaaagctagcagaaggcaagaaataacgaaaatcagagcagaactgaaggaaatagagacacaaaaaacccttcaaaaaattaatgaatccaggagctggttttttgaaaggatcaacaaaattgatagaccactagcaagactaataaagaaaaaaagacagaagaatcaaatagacgcaaaaaaaatgataaaggggatatcatcactgatcccacagaaatacgaactaccatcagagaatactacaaacacctctatgcaaataaactagaaaatctagaagaaatggataaattcctcgacacatacactctcccaagactaaaccaggaagaagttgaatctctgaatagaccaataacaggctctgaaattgtggcaataatcaatagcttaccaacaaaaaagagtccaggaccagatggattcacagccgaattctatcagagttacaaggaggaactggtaccattccttctgaaactatcccaatcaataaaaaaagagggaatcctccctaactcattttatgaggccagcatcatcctgatacaaaagccaggcagagacacaaccaagaaagagaattttagaccaatatccttgatgaacattgatgcaaaaatcctcaatataagaccggcaagcagaatccagcagcacatcaaaaagcttatccaccatgatcaagtgagcttcatccctgggatgcaaggctggttcaatatatgcaaatcaataaatgtattccagcatataaacagaaccaaagacaaaaaccacatgattatctcaatagatgcagaaaaggcctttgaaaaaattcaacaactcttcatgctaaaaactctcaataaattaggtattgatgggatgtatttcaaaataataagagctatctatgacaaacccacagccaatatcatactgaatgggcaaaaactggaagcgttccctttgaacactggcacaagagagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcttgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcagtatcatgaaaatggccatactgcccaaggtaatttatagattcaatgccatccccatcaagctaccaatgactttcttcacagaattggaaaaaactactttaaagctcatatggaaccaaaaaagagtccgcatcgcgaagtcaatcctaagccaaaagaacaaagctggaggcatcacactacctgtcttcaaactatgctacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcacgggcttcatgtctaaaacaccaaaagcaatggcaacaaaagccagaattgacaaatgggatctaattaaactaaagagcttctgcacagcaaaagaaactaccatcagagtgaacagacaacctacaaaatgggagaaaattttcgcaacctactcatctgagaaagggctaatatccagaatctacaatgaactcaaacaaatttacaagaaaaaaacaaacaacaccatcaaaaagtgggcgaaggacatgaacagacacttctcaaaagaagacatttatgcagccaaaaaacacatgaaaaaacgctcatcatcactggccatcagagaaatgcaaatcaaaaccacaatgagataccatctcacaccagttagaatggcaatcattaaaaagtcaggaaacaacaggtgctggagaggacgtggagaaataggaacagttttacactgttggtgggaccgtaaactagttcaaccattgtggaagtcagtgtggtgattcctcagggatctagagctagaaataccatttgacccagccatcccattagtgggtatatacccaaaggactataaatcatgctgctataaagacacatgcacacgtatgtttattgcggcactattcacagtagcaaaaacttggaaccaacgcaaatgtccaacaatgatagactggattaagaaaatgtggcacatatacaccgtggaatactatgcagccataaaaaaggatgacttcatgtcctttgtagggacatggatgaaattggaaatcatcattctcagtaaactattgcaagaacaagaaaccaaacaccgcatattctcagtcatagatgggaattgaacaatgagaacacatggacacaggaaggggaacatcacactctggggactgttgtggggttgggggagggtggagggatagcattgggagagatacccaatgctagatgatgggttagtgggtgcagcgcaccagcatggcacatgtatatatatgtaactaacctacacattgtgcacatgtaccctaaaacttaaagtataataaaaaaaaagatattagaaaaaaa

SEQ ID NO: 12586 - DNA, 6054 bp, Homo sapiens
tttttttttttttaactcattttttttattatactttaagttttagggtacatgtgcacattgtgcaggttagttacatatgtatacatgtgccacgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtggcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatagtatctcattgtggttttgatttgcatttctctgatggccagtgatgatgagcattttttcatgtgttttttggctgcataaatgtcttcttttgagaagtgtctgttcatgtccttcgcccactttttcatggggttgattgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttcgtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatggctccagctttgttcttttggcttaggattgccttggcaatgcgggctcttttttggttccatatgaactttaaagtagttttttccaatgctgtgaagaaagtcattggtagctttatggggatagcactgaatctgtaaattaccttgggcagtgtggccattttcacaatattgattcttcctacccatgagcatggaatgttcttccatttgtttgtatcctcttttatttccttgagcagtggtttgtagttctccttgaagaggtccttcacatcccttgtaagctggattcctaggtattttattctctttgaagcaattgtgaatgggagttcactcatgatttggctctctgtttgtctgttgttggtgtataagaacgcttgtgatttttgtacattgattttgtattctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatattgaataggagtggtaagagaaggcattcctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctgttgattggaatagtttcagaaggaatggtaccagctcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctcttatggtagtttgtatttctgtgggatcagtggtgatatcccctttatcattttttattgtgtctatttgattcttctctctttttttctttattagtcttgctagtggtctatcaattttgttgatcctttcaaaaaaccagctcctggattcattaattttttgaaggcttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttgttttcaaagaacatctttatttctgccttcatttcgttatgtacccagtagtcattcaggagcaggttgttctgtttccatgtagttgagcagttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatgttctgttgatttggggtggagagttctgtagatgtctattaggtccgcttggtgcagagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattcatccctttaccattatgtaatggccttctttgtctcttttgatctttgttggtttaaattctgttttatccaagactagtattgcaacccctgcctttttttgttttccatttgcttggtagatcttcctccatccttttattttgagcctatgtgtgtctctgcccgtgagatgtgtttcctgaatacagcacactgatgggtcttgactctttatccagtttgctagtctgtgtcttttaattggagcatttagtccatttacatttaaagttaatattgttatgtatgaatttgatcctgtcattatgatgttagctggtggttttgcttgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgatcgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccaccactaataccctttcttccagttgatcgcatcggctcctgaggcttctgcattcttcacgtggttctcgagccttggttttcagctccatgagctcctttaagcacttgtctctattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgtttttttcccatctttttggttttatctacttttggtctttgatgatggtgatgtacagatgggtttttggtgtggatgtcctttctgtttgttagttttccttctaacagataggaccctcagctgcaggtctgttggaataccctgccatgtgaggtgtcagtgtgcccctgctggggggtgcctcccagttaggctgctcaggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccattggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagccagactccgtgggcgtaggaccctccgagccatgtgcgggatataatctcgtggtgcgcggttttttaagccggtcggaaaagcacaatattcgggtgggagtgacccgattttccaggtgcgtccatcacccctttctttgactcggaaagggaactccctgaccccttgcgcttcccaagtgaggcaatgcctcgccctgcttcagctcacgcacggtgcacgcacccactgacctgcgcccactgtctggcaatccctagtgagatgaacctggtacctcagatggaaatgcagaaatcacccgtcttctgcgtcgctcacgctgggagctgtataccggagctgttcctattcagccatcttggctcctccgatgaaaaatt

SEQ ID NO: 12587 - DNA, 6075 bp, Homo sapiens
tttttttttttcagtcattatttgtttgtacagctgtgtgaattttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgcgatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgcctttctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttgttgtaaatttgtttgagttcattgtagattctggatattagccctttgtcagatgagtaggttacgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagtttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaaatttgtcaaaggttttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtggtcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactgaagacttgctttatgaatctgggtgctcctgtattgggtgcataaatatttaggatagttagctcctcttgttgaattgatccctttaccattatgtaatggccttctttgtctcttttgatctttgttggtttaaagtctgttttatccgagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtcttgatggtctttacagtttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaacgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctccttgataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcgtcaaaatcattctccatccagctttgttctgttgctggtgaggaactgctttcctttggaggaggagaggcgctctgcgttttagagtttccagtttttctgttctgtttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggtgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtcagtcacccctttctttgactcagaaagggaactccctgaccccttgcgcttcccaggtgaggcaatgcctcgccctgcttaggctcgcgcacggtgcgcacacacactggcctgcgcccactgtctggcactccctagtgagatgaacccggtacctcagatggaaatgcagaaatcacctgtcttctgcgtcgctcacgctgggagctgtagtccggagctgttcctattcggccatcttggctcctcctccta

SEQ ID NO: 12588 - DNA, 10367 bp, Homo sapiens
cccagtacttctttttttttttttttttttttgagatggtgtctcgctctgtcacccaggctggagtgcagtggtgcgatctcggctcactgcaagctccacctcccaggttcacaccattctcctgcctcagcctcccgagtagctgggactacaggcgcccgccaccacgcccagctatttttttgtattttttagtaaagacggggtttcaccgtgttagccaggatggtctcgatctcctgacctcgtgatctgcccacctcggcctcccaaagtgctgggacccagtacttctttaagagagcactgaccttatattgctcccagtacctcgttagggcactgaccttatatctgctgccagtggactcatcccagtgtccccattcgtcttgtcaatttcagcttctctgcttcagcagaccttcttcgttcatgtcctcagagtccctgttctggggtgccactttgatgcgtgaatggaccttggtggactgaacaaagggggacgaatgcgagaataaagataaagacaaaaaagcatatttggaagacatggtcgggggctccttgcttctagtgaacaagggccctgagctttagagccctttgtatttattgggtaaaggagatagggagaagggtggggggtggttggtggtcagcagcttgatttacagcaggcttgcaagactgcattatttgaacagtaggctctggatgtcccagtagataacctcaaggcatacagtgccggggagtgattgccctcagcaaaccttctggtggctggagcagaagcaagtttgctcacattctgcattcatgataaacagtttgctgtttgatcatatagcctcagtggaatgctgagttggtcacgacccacgggcattcagctctctatgaaaaggagcctggcatctctcttgctccctcctgccatcggatatgccagctccccctttgccttctgacaggctttctaagcttcctgaggcttcaccggaaacagaacagatgctagtgctgtgcttgtacagcctgcagaaccatgagccaaatcaatctcgtttctttataaattactctgcttcacagctgggcatggtggctcacatctgtaatcccagcactttgggaggccgaggtaggtggattactgaggtcaagagttcgagaccagcctgaccaacatggtgtaaccccatctctaataaaaatacaaaaattagccaggcatggtagggcatgcctgtaatcccagctacccaggaggctgaggcatgagaattgcttgaacccaggaagcagaggttgcagtgggccaagatcgtgccactgcattccagcctaggcaacagagccagaccctgtctcaaaaaaataaaaataaaaaattacccagcttcaggtattcttttatagcaatgcaaaacagactaacacactgtctttttttctcagctgtaaagtgagaataatcattgtgaaatgagatattaaaattctttggaatcatgcctcctcagcagctttacaaggctaccatgtggagttgttcagtgggtatagagtttcagttttgcaacatgaaaaagttcttgagactggctgcacaacagtgtggatatacttaacgttactgaattgtactcttagaaatcgttaggatgaagctgggcacggtggcttatgcctgtaatcccagtactttgggaggcagaggagggtggatcatctgaggtcaggagtttgagaccagcctggtcaacatggtgaaatcccgtctctactaaaaatacaaaaaattacttgggcatggtggtgggtgcctgtaatcccagctactcaggaggctgaggcaggagaatcgcttgaacccaggaggcggaggttgcagtgagccgagattgcaccattgcacgccagcctaggtgacagagcaagactccatctcaaagaaaaaagaaatggttaggctggtacattttatgctatgcattgtttctcagaataacaaaatttttaaggaaatgaccaccacgtgagatacctaaaaagctgtcccaggagagggatgatatttattctgtgagctctgagaggggagacaggagccagttagcaaccactgagtactccagccggcccacaaagccccagcatggatgctgcacctgagtgaggctggccttggagacctctgggccccttccagctcagaggtctgaaggatttgagctgagtcaggtcagcagatgctagaactttccattcacagactgtccagttttgctatatttgaggaacagaaacaggtcagaaagcagggcatgctctcatactactaggaaaacataatgtgatgcaacctttattattatcatttatagtattatttttaaattttgttatttatttattattttatttatttttttttgagatggattttccctcttgttgccccagctggagtgcacttgcacaatctcggctcactgcaacctctgcctcccagtttcaaatgattctcctgcctcagcctcctgagtagctgggactacaggcgtgtaccaccatgcccagctaatttttgtatttttagtagagaccgggtttctgcatgttggccaggctggtctcaaactcctgacctcaggtgatccgcccgcctcagcctcccaaagtgctgggattacaagtgtgagccaccgtgcccaatctttttatttattttattgagataaggtcttgctgtgttactcaggctggtcttgaactcctggccttccagagtgccaagattacaggtgtgagccaaggtgcccagaaggcacaacctttctggcaggcattcacaactaagaacttaatccaagagcacaattggccaagcgtgtgacgttagagaagagcactgttgttgtgaacttcaaccaatgaagatggcctgagaaaaacctgtgacagcttggcagaattcagaaggatgagacatcactccaactgagccacgaaaatatggtctggaggcagggaacataagcccaattcacacttcagctatgacagaaaatatcctctccatttacatagggcgtacaccgagtaaatgactttgtaactttacttcattctcttcttttacatagggtgtacactgagtaaatgaccttgtaactttacttcatcctctttatttacatatggcgtacaccaagtaaatgactttgtagctctacttcatcctcttcatttatgtaggacatataccaaggaactgatggaaacttctagagggtatttaaaccccaaaacattctgtaatggggcccttgagcccctatgctcagcctgctaccacactgtggagtatactttcattttcaataattttcttcatttctttccttgctttgtgcgttttgtccaattttttgttcaagacaccaagaacctggacaccctccaccggtgacacaaccatcaggcaataggggtacacctgggaaggacaagggacagttagtgcagtgaggaatgggaggcagggccgagtctctctgagctgggaggctgctccttctggcctctccaaagcctcactgcttccatttcccgaggcagataaggactgcctcagcctgggacaaaacgacctctctgtgtccacagccacccacaattggcataatgttccagtctcacttcccaggagcctctgaagggcccagcttgggtcagatggccattcctgggccagtcagctatggccaggggatggggtcacatggcacccacatgaagcaaggcctatcccttaagtaggggctgttgagtgacaggaaccgtggaggtgttgacagccgctcctcaaagtatggtcctagactgagcagcagcacttacatcactcggcagcttcttagcaatacagaatctcaggccccaccccacacctaaggaatcagaatctgcttatttatttatttattttgatgataggtgcatgccaccacacttggctaatttttgtatttttagtggagtcagggtttctccatgttggccaagctgatctcaaactcctgacctcaagtgatccacccgcctcagcctgccaaagtgctggaattacaggcgtgagccaccgcacccagcctgtagcccacatattgatcctgtctgttctttttttctttttattattattattattattatactttaagttttagggtacatgtgcacaatgtgcaggttagttacatatgtatacatgtgccatgctggtgtgctgcacccattaactcatcatttagcatcaggtatatctcctaatgctatccctcccccctcccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacttgtgcatgtgtctttatagcagcatgatttatagtcctttgcgtatatacccagtaatgggatggctgggtcaaatggtatttctagttctagatccctgaggaatcgccacactgacttccacaatgcttgaactagtttacagtcccatcaacagtgtaaacatgttcctgtttctccacatcctctccagcacctgttgtttcctgactttttaatgattgacattttaactggtgtgagatggtatctcgttgtggttttgatttgcatttctctgatggccagtgatgatgagcattttttcatgtgtctgttggctgcataaatgtcttcttttgagaagtgtctgttcatatcctttgcccactttttgatgggattgtttgtttttttcttgtaaatttgtttgagttcattgtagattctggatattagtcttttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaacccatcatgaattaatttttgtataaggtgtaaggaagggatccagtttcagctttctacatatggctagccagttttcccagcaccatttattaaataggaaatcctttccccattgcttgtttttctcaggtttgtcaaagatcagatagttgtagatctgtggcattatttctgagagctttgtcctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaattttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcattgagcagtggtttgtagttctctttgaagaggtccttcacatcccttgtaagttggattcctaagtattttattctctttgaagcaattgtgaatgggagttcactcatgatttggctctctgtttgtctgttactggtgtataacaatgcttgtgatttttgtacattgattttgtatcttgagactttgctgaacttgcttatcagcttaaggagattttgggctgagacaatggggttttctagatatacaatcatgtcgtctgcaaacagggacaatttgacttcctcttttcctaattgaataccctttatttccttctcctgcctaattgccttggccagaacttccaacactatgttgaataggagtggtgagagagggcatccctgtcttttgccagttttcaaggggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttagttctgtttatctgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcacaaaatgagttagggaggattccctctttttctattgattggaatagtttcagaaggaatggtattagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcttgctttctctcgtgggcatttagtgctataaatttccctctacacactgctttgaatgtgtcccagagattctggtatgttgtgtctttgttcttgttggtttcaaagaacatttttatttctgccttcatttcgttatgtactcagtagtcattcaggagcaggttgttcagtttccatgtagttgagcggttttgagtgagtttcttaatcctgaattctagtttgattgcactgtggtctgagagacagtttgttataatttctgttcttttacatttgctgaggggagctttacttccaactatatggtcaattttggaataggtgtggcgtggtgctgaaaaaaatgtatattctgttgatttggggtggagagttctgtagatgtctattaggtccgcttggtgcagagctgagttcaattcctgggtatccttgttaactttctgtcttgttgatctgtctaatgttgacagtgggtgttaaagtctcccattattattgcttgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgtttggtagatctttctccatccttttattttgaccctatatgtgtctctgcacatgagatgggtttcctgaatacagcacactgatgggtcttgactctttatcaaacttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtacaagtttttcctttccatgtttagtgcttccttcgggagctcttttagggcaggcctggtggtgatgaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcaatttcaggtacaccaatcagacgcagatttggtcttttcacatagtcccatatttcttggaggctttgttcatttctttttattcttttttctctaaacttcccttctcgcttcgtttcattcatttcatcttccatcactgataccctttcttccagttgatcacatcggctcctgaggcttctgcattcttcacgtagttctcaagccttggctttcagctccatcagctcctttaagcacttctctttattggttattctagttatacattcgtccaaaattttttcaaagttttcaacttctttgcctttggtttgaatttcctcctgtagctcggagtagtttgatcatctgaagccttcttctctcaactcgtcaaagtcattctccatccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtatggatgtcctttctgtttgttagttttccttctaacagacaggaccctcagctgcaggtctgttggagtttgctagaggtccactccagaccctgtttgcctgggtatcagcagcggtgtctgcagaaccgtggattttcgtgatccgtgaatgctgttgtctgatcgttcctctggaagttttgtctcagaggagtacccggccgtgtgaggtgtcagtctgcccctactggggggtgcctcccagttaggctgcttgggggtcaggggtcagggacccacttgaggaggcagtctgccccttctcagatctccagctgcgtgctgggagaaccactgctctcctcaaagctgtcagacagggacatttaagtctgcagaggttactgctgtctttttgtctgtgccctgcccccagaggtggagcctaccgaggcaggcaggcctccttgagctgtggtgggctccacccagttcgagcttcctggctgctttgtttacctaagtaagcctgggcaatggcgggcacccctcccccagcctccctgctgccttgcagtttgatctcggactgctgtgctagcaatcagcgagactccttgggcataggaccctccgagccaggtgcggggtacaatctcctggtgcgccgtttcctaagcccgtcggaaaagcgcaatattcgggtgggagtggcccgattttccaggcgctgtctgtcacccctttccttgaccaggaaagggaactccctgaccccttgtgcttcctgagtgaggcaatgcctcaccctgcttcggctggcgcatggtgcactacacccactgtcctgcgcccactgtctggcactccctagtgagatgaacccagtatctcagatggaaatgcagaaatcactcgtcttctgcggtgctcatgctgggagctgtagaccggagctgttcctattcggccatcttggctcctcc

SEQ ID NO: 12589 - DNA, 6071 bp, Homo sapiens
caaaatatactttttatttttatttttttattttttttaattttattattatactttaagttttagggtacatgtgcacaatgtgcaggttagttacatatgtatacatgtgccatgctggtgtgctgcacccactaactcgtcatctagcattaggtatatctaccaatgctatccctcccccctccccccaccccacaacagtccccagagtgtgatgttccccttcctgtgtccatgtgttctcattgttcaattcccacctatgagtgagaatacgcggtgtttggttttttgttcttgcgatagtttactgagaatgatgatttccaatttcctccatgtccctacaaaggacacgaactcatcattttttatggtggcatagtattccatggtgtatatgtgccacattttgttaattcagtctatcattgttggacattttggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtacagaagctcttaagtttaattagatcccatttgtcaattttgtcttttgttgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggccagccagttttcccagcaccatttattaaatagggaatcctttccccattgcttgtttttctcaggtttgtcaaagatcagatagttgtagatatgcggcgttatttctgagggctctgttctgttccactgatctatatctctcttttggtaccagtaccatgctgttttggttactgtagccttgtagtatggtttgaagtcaggtagcgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttgcatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggaaaatttgacttcctcttttcctaattgaataccctttatttccttctcctgcctaattgccctggccagaacttccaacactatgttgaataggagtggtgagagaggtcatccctgtcttgtgccagttttcaaagggaatgcttccagtttttgcccattcagtatgatattggctgtgggtttgtcatagatagctcttaatattttgagatacatcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcattccagggatgaagcccacttgatcatggtggataagctttttgatgtgctgctggattcattttgccagtattttattgaggatttttgcatcaatgttcatcaaggatattggtctaaaattctcttttttggttatgtctctgccaggctttggtatcagaatgatgctggcctcataaaatgagttacggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggattggtggtgatatcccctttatcattttttattgtatctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttaggtacccagtagtcattcaggagcaggttgttcagtttccatgtagttgagcggttttgagtgagattcttaatcctgagttctagtttgattgcactgccgtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatcctttttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctctcttgatctttgttggtttaaagtctgttttatcagagactaggattgcaacccctgcctttttttgttttccatttgcttggtagatcttcctccatccttttattttgagcctatgtgtgtctctgcacatgagatgggcttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcgttagttgatgcagtttcttcctagtctcgatggtctttacattttggcatgattttgcagcggctggtactggttgttcctttccatgtttagcgcttccttcaggagctcttttagggcaggcctggtggtgacaaaatctctcagcgtttgcttgtctgtaaagtattttatttctccttcacttatgaagcttagtttggctggatatgaaattctgggttgaaaattcttttctttaagaatgttgaatattggcccccactctcttctgtcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataacatcctgcagagtgttttccaacttggttccgttctccccgtcactttcaggtacaccagtcagacgtagatttggtcttttcacatagtcccatatttcttggaggctttgctcatttctttttattcttttttctctaaacttcccttcttgcttcatttcattcatttcatcttccattgctgataccctttcttcgagttgatcgcatcggctcctgaggcttgtacattcgtcacgtagttctcgagccttggttttcagctccatcagctcctttaagcacttgtctgtattggttattctagttatacattcttctaaatttttttcaaagttttcaacatctttgcctttggtttgaatgtcctcccgtagctcagagtaatttgatcgtctgaagccttcttctctcagcttgtcaaagtcgttctccatccagctttgttccgttgctggtgaggaactgcgttcctttggaggaggagaggcgctctgctttttagagtttccagtttttctgttctgttttttccccatctttgtggttttatctacttttggtctttgatgatggtgacgtacagatgggtttttggtgtggatgtcctttctgtttgttagttttccttctaacagacaggaccctcagctgcaggtctgttggagtaccctgccgtgtgaagtgtcagtgtgcccctgctggggggtgcctcccagttaggctgcttgggggtcaggggtcagggacccacttgaggaggcagtctccccgttctcagatctccagctgcgtgctgggagaaccactgctctcttcaaagctgtcagacagggacatttaagtttgcagaggttactgctgtctttttgtttgtctgtgccctgcccccagaggtggagcctacagaggcaggcaggcctccttgagctgtggtgggctccacccagttcgagcgtcctggctgctttgtttacctaagcaagcttgggcaatggcgggtgcccctcccccagcctcgctgccgccttgcagtttgatctcagactgctgtgctagcaatcagggagactccatgggcgtaggaccctctgagccaggtgcgggatataatctcgtggtgcaccgttttttaagccggttggaaaagcgcagtattcgggtgggagtgacccgattttccaggtgcgtccatcacccctttctttgactaggaaagggaactccctgaccccttgcgcttcccaagtgaggcaatgcctcaccctgcttcggctcgcacacggtgcgcgcacccactgacctgcgcccactgtctggcacttcctagtgagatgaacccggtacctcagatggaaatgcagacatcacccgtcttctgcgttgctcacgctgggagctgtagaccggagctgttcctattcggccatcttggctcctccctcgaaaa

SEQ ID NO: 12590 - DNA, 5722 bp, Homo sapiens
atgtgaaaattctttttttttaattatactttaacttttagggtacatgtgcacaatgtgcaggttggttacatatgtatacatgtgccatgttggtgtgctgcacccattaactcatcatttaacattaggaatatctcctaatgctatccctcccgcctccccccaccccacaacaggccccggcgtgtgatgttccccttcctgtgtccatgtgttctcattgttcaattcccacctatgagtgagaacatgcagtgtttggttttttgtctttgcgatagtttgctgagaatgatggtttccagcttcatccatgtccctacaaaggacgtgaactcatcattttttatggctgcatagtattccatgctatatatgtgccacattttcttaatccagtctatcattgttggacatttgggttggttccaagtctttgctattgtgaatagtgccacaataaacatacgtgtgtacgtgtctttatagcagcatgatttatagtcctttgggtatatacccagtaatgggatggctgggtcaaatggtatttctagttccagatccctgaggaattgccacactgacttccacaatggttaaactagtttacagtcccaccaacagtgtaaaagtgttcctatttctccacatcctctccagcacctgttgtttcctgactttttagtgattgccattctaactggtgtgagatggtatctcattgtggttttgatttgcatttctctgatggccagtgatgatgagcattttttcatgtgccttttggctgcataaatgtcttcttttgagaagtgtctgttcatatccttcgcccacttgttgatggggttgtttttttcttgtaaatttgtttgagttcattgtagattctggatattagccctttgtcagatgagtagattgcaaaaattttctccgatgctgtaggttgcctgttcactctgatgggagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaatggttaagtctttaatccatcttgaattaatttttgtataaggtataaggaagggatccattttcagctttctacatatggctagccagttttcccaacaccatttattaaatagggaatcctttccccatttcttctttttgtcaggtttgtcaaagatcagatagttgtagatatgcgacattatttctgagggctctgttctgttccattggtctatatctctgttttggtaccaataccatgctgttttggttactgtagccttgtagtatagtttgaagtcaggtagcgtgatgcctccagctttgttcttttggcttaggattgacttggcaatgagggctcttttttggttccatatgaactttaaagtagttttatccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaaattggattcctagatattttattctctttgaagcaattgtgaatgggagttcactcatgatttggctttctgtttgtctgttgttggtgtataagaatgcttctgatttttgcacattgattttgtatcctgagactttgctgaagttgcttatcagcttaaggagattttgggctgagacgatggggttttctagatatacaatcatgtcatctgcaaacagggacaatttggcttcctcttttcctaattgaataccctttatttccttcccctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagcttattattttgagacacatcccatcaatacctaatttattgagagtttttagcatgaaggttgttgaattttgtcaaaggctttttctgcatctattgagataatcatgtggtttttgtcattggttctgtttatatgctggattacatttattgatttgcatatgttgaaccagccttgcatcccagggatgaagcccacttgatcatgatggataagctttttgatgtgctgctggattcagtttgccagtattttattgaggatttttgcatcaatgtttatcacggatattggtctaaaattctctttttttgttgtgtctctgcccggctttggtatcaggatgatgctggcctcataaaatgagttagggaggatttcctctttttctattgattggagtagcttcagaaggaatggtaccagctcctccttgtacctctggtagaattcgactatgagtccgtctggtcctggacttgttttggttggtaagctattaattattacttcaatttcagagcctgttattggtctattcagagattcaacttcttcctggtttagtcttgggagggtgtgtgtgtctaggaatttatccatttcttctagattttctaatttatttacatagaggtgtttgtagtattctctgatggtagtttgtatttctgtgggatcggtggtgatatcccctttaacattttttattgcatctatttgattcttctctcttttcttctttattagtcttgctagcggtctatcaattttgttgatcttttcaaaaaaccagctcctggattcattgattttttgaagggttttttgtgtctctatttccttcagttctgctctgatcttagttatttcttgccttctgctagcttttgaatgtgcttgctcttgcttctctagttcttttaattgtgatgttagggtgtcaattttagatctttcctactttctcttgtgggcatttagtgctataaatttccctctacacactgctttgaatgtgtcccagagattctggtatgtggtgtctttgttctcattggtttcaaagaacatctttatttctgccttcatttcgttatgtacccagtagtcattcaggagcaggttgttcagtttccatgtagttgagcggttttgagtgagtttctgaatcctgagttctagtttgattgcactgtggtctgagagacagtttgttataatttctgttcttttacatttgctgaggagtgctttacttccaagtatgtggtcaattttggaataggtgtggtgtggtgctgaaaagaatgtgtattctgttgatttggggtggagagttctgtagatgtctattaggtctgcttggtgcagagctgagttcaattcctgggtatccttgttaactttctgtctcgtggatctgtctaatgttgaaagtcgggtgctaaagtctcccattattattgtgtgggagtctaagtgtctttgtaggtcctaaggacttgctttatgaatctgggtgctccttattgggtgcatatatatttaggatagttagctcttcttgttgaattgatccctttaccattatgtaatggccttgtctcttttgatctttgttggtttaaagtctgttttatccgaggctaggattgcaacccctgcctttttttttttttccatttgcttggtagatcttcctctatccctttattttgagcctatgtgtgtctctgcccgtgagatgggtttcctgaatacagcacactaatgggtcttgactctttatctaatttggcagtctgtgtcttttaattggagcatctagcccatttacatttaaggttaatattgttatgtgtgaatttgatcctgtcattatgatgttagctggtgattttgcgcgttagttgatgcagtttcttcctagcctcgatggtctttacaatttggcatgtttttgcagtggctggtaccgattgttcctttccatgtttctgcttccttcaggagctcttttagggcaggcctggtggtgacaaaatctctcagcatttgcctttctgtaaagtattttatttctccttcacttatgaaacttagtttggctggatatgaaattctggtttgaaaattcttttctttaagaatgttgaacattggcccccactgtcttctggcttgtagagtttctgccgagagatcagctgttagtatgatgggcttccctttgtgggtaacccgacctttctctctggctgcccttaacattttttccttcattttaacttttgtgaatctgacaattatgtgtcttggagttgctcttctcaagaagtatctttgtggcattctctgtatttcctgagtctgaattttggcctgccttgctagattggggaagttctcctggataatatcctgaggagtgttttccaacttggttccattctccccatcactttcaggtacaccagtcagatgtacatttgatcttttcacatagtcacatatttcttggaggctttgttcatttctttgtattcttttttctctaaacttctcttcttgcctcatttcattcatttgatcttcagtcactgataccctttcttccagttgatcgaatcggctactgaggcttgtgcattcgtcatgtagttcttgtgccatggttttcagctccatcaggtcctttaaggacttctctgcattggttattctagttagccattcatctaatcttttttcaaggcttttaacttgtttgccgtgggttcgaactacctctttgagctcagagtagtttgatcgtctgaagccttcttctctcaattcgtcaaagtcattctccatccagctttgttccgttgctggtgaggaactgcgttcctttggaggaggagaggcactctgatttttaaaattttcagtttttctgctctgttttttccccatctttgtggttttatctacctttggtctttgatgacgatgacgtacagatggagttttggtgtgggtgtcctttctgttcattagttttccttctaacagtcaggaccctcagctgcaggtctgttgaggtttgctggaggtccactccagaccctgtttgcctgggtatcagcagcagaggctgcagaacagcggatattggtgaatagcaaatgttgctgcctgatcgttcctctggaagttttgtctcagaggagtacccggccttgtgaggtgtcagtctgcccctactcgggggtgcctcccagttaggctacttgggggtcagggacccacttgaggaggcagtctgtccattctcagatctcaagctgcaggctgagagaaccactactctcttcaaagctgtcagacaaggacatttaagtctgtagaggtttctgctgccttttgtttggctatgccatgcccccagaggtggagactacagaggcaggcaggcctccttgagctgcgatgggctccacccagttcgagcttcctggctgctttgtttacctactcaagcctcggcaatggtgggcacccctcccccagcct

SEQ ID NO: 12591 - DNA, 6600 bp, Homo sapiens
tattcttttattttattttattttattattattatactttaagttttagggtacatgtgcacaatgtgcaggtttgttacatatgtatacatgtgccatgttggtgtgctgcacccattaactcgtcatttagcattaggtatatctcctaatgctttccctcccctcttcccccaccccacaacagtccccggagtgtgatgttccccttcctgtgtccatgtgttctcattgttcagttcccacctatcagtgagaagatatggtgtttggttttttgtccttgcaatagtttgctgagaatgatggtttccagcttcatccatgtccctacaaaggacatgaactcttcattttttatggctgcatagtattccatggtgtatatgtgccacattttcttaatccagtctatcattgttggacatttgggttggttccaagtctttgctattgtgaatagtgccacagtaaacatacgtgtgcatgtgtctttatagcagtgtgatttataatcctttgggtatatacccagtaatgggatggctgggtcaaatggtatttctagttctagatccctgaggaatcgccacactgacttgcacaatggtggaactagtttacagtcccaccaacagtgtaaaagtgttgctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtctgtttttttcttgtaaatttgtttgagttcattgtagattctggatattagccctttgtcagatgagtaggttgcaaaaattttctcccattttgtaggttgcctgttcactctgatggtagtttcttttgctgtgtagaagctctttagtttaattagatcccatttgtcaattttgtcttttgttgccattgcttttggtgttttagacatgaagtccttgcccatgcctatatcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggttgtagatatgcggcattatttctgagggctctgttctgttccattggtctatacctctgttttggtaccagtaccatgctgctttggttactgtagccttgtagtatagtttgaagtcaggtagcatgatgcctccagctttgttcttttggcttaggattgacttggcaatgtgggctcttttttggttccatatgaagtttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttcactgagcagtggcttgtagttctccttgaagaggtccttcacatcccttgtaagttagattcctaggtattttattctctttgaagcaattgtgaatgggagttcactcatgatttggctctctgtttgtctgttattggtgtataaggatgcttgtgatttttgcacattgattttgtatcctgagactttgctgaagttgcttatcagcttaaggtgattttgggctgagacagtggggttttctagatatacaatcatgtcatctgcaaacagggacaatttggcttcctattttcctaattgaataccctttatttccttctcctgcctaattgccctggccagaacttccaacactatgttgaataggagtggtgagagagggcatccctgtcttgtgccagctttcaaagggaatgcttccagtttttgcccattctgtatgatattggctgtggatgtgtcatagatagctcttattattttgagatatgtcccatcaatacctaatttattgagagtttttagcatgaagtgttgttgaattttgtcaaaggccttttctgcatctattgagataatcgtgtggtttttgtctttggttctgtttatatgctggattacatttattgattttcatatgttaaaccagccttgcatcccagggatgaagcccacttgatcatggtagataagctttttgatgtgctgctggattcggtttgccagtattgtattgaggatttttgcatcagcgttcatcaaggatattggtctaaaactctctttttttgttgtgtctctgccaggctttggtatcaggatgatgctggcctcataaagtgagttagggaggattccctctttttctattgattggaatagtttcagaaggaatggtaccagctcctccttgtacgtctggtagaatttggctgtgaatccatctgctcctggactttttttggttggtaagctattgattattgccacaatttcagagtctgttattggtctattcagagattcaacttcttcctgttttagtcttgggatggtgtatgtgtcgaggaatttatccatttcttctagattgtctagtttatttgcgtagaggtgtttgtagtattctgtgatggtagtttgtatttctgtgggatcggtggtgatatcccctttatcattttttattgcatctatttgattcttctctcttttcttctttattagtcttgctagcagtctatcagttttgttgatcttttcaaaaaaccagctcctggattcattaattttttgaacggtattttgtgtctctatttccttcagttctgctctgattttagttatttcttgccttctgctagcttttgaatgtgtttgctcttgcttttctagttcttttaattgtgacgttagggtgtcaattttggatctttcctgctttctcttgtgggcatttagtgctataaatttccctctacacactgctttgaatgtgtgccagagatactggtatgttgtgtctttgtttccgttggtttcagagaacatctttatttctgccttcatttcgttatgtacccagtagtcattctggagcaggttgttcagtttccatgtagtggagcggttttgagtgagtttcttaatcctgagttctagtttgattgcactgtggtctgagagacagtttgttataatttctgtttacatttgctgaggagtgctttacttccagctatgtggtcaattttggaataggtgtggtgtggtgctgaaaagaatgtatattctgttgatttagggtggagagttctgtagatgtctattaggtccgcttggtgcagagctgagttcaattcctgggtatcctttttaactttctgtctcgttgatctgtctaatgttgacagtgggttgttaaagtctcccgttattattgtgtaggagtctaagtctctttgtaggtcactaaggacttgctttatgaatctgggttgtcctgtattaggtgcatatacatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctatccagtttgtcagtctgtgtcttttaattggagcatttagcccatttacatttaaggttaatattgttatgtgtgtatttggtcttgtcattatgatgttagctggttattttgctcgttagttgatgcagtttcttcctagccttgatggtctttacattttgtcatgtttttgcagtggctggtaccggttgttcctttccatgtttagtgcttctttcaggagctcttttagggcaggcctggtggtgacaaaatctctcagcatttgcttgtctgtaaaggattttatttccccttcacttatgaagcttagtttggctggatatgaaaattctgggttgaaaattcttttctttaagaatgttgaatattggtccccactctcttctggcttgtagagtttctgccgagagatccgctgttagtctgatgggcttccctttgtgggtaacccgacctttctctctggctgcccttaacattttgtccttcatttcaactttggtgaatctgacaattacgtgtgttggagttgctcttctcgaggagcatctttgtggcgttctctgtatttcctgaatctgaatgttggcctgccttgctagattggggaagttctcctggataatatcctgcagagtgttttccaacttggttccattctccccatcactttcaggtacaccaatcagacgtagacttggtcttttcacatagtcccatatttcttggaggctttgttcatttctttttattctttttttctctaaacttcccttctcgcttcagttcattcatttcgtcttccatcactggtaccctttcttccagttgatcgcatcagctcccgaggcttctgcattcttcacgtagttcttgagccttggctttcagctacctcagctcctttaaggacttctctgcattggttattctagttagccattcgtctacttttttttcaaggtttttaacttctttgccattggttcgaactttctcctttagctcagagtagtttgatcttctgaagccttcttctctcaacacgtcaaagtcattctccttccagctttgttccattgctggtgaggagctgcgttcctttggaggaggagaggcgctctgatttttagggtttccagtgtttctgctttgtttttttcccatctttgtggctttatctacttttggtctttgatgttggtgatgtacagaagggtttttggtgtggatgtcctttctgtttggtagttttccttttaacagacaggaccctctgctacaggtctgttggagtttgctagaggtccactccagaccctgtttgcctgggtatcagcagcggtggctgcagaacagcggtggctgtagaacagtggatgttggtgaaccgcaaatgctgctgcctgatcgttcctctggaagttttgtctcagaggagtacccggccgtgtaaggtgtcagtgtgcccctactggggggtgcctcccagttaggctgctcgggggtcacggacccacttgaggaggcagtctgcccattctcagatctccagctgcgtagtggaagaaccactactctcttcaaagctgtcagacagggacctttaagtctgcagaggttactgctgtctttttgtttgtctgtgccctgcccccagaggtggagcctacagaggcaggcaggcctccttgagctgtggtgggctccacccagttggagcttcggggctgctttgtttacctaatcaagcctgggcaatggcaggcgcccctcccccagccttgctgctgccttgcagtttgatctcagactgctgtgctagcaatcagcgagactctgtgggcataggaccctccgagccaggtgcgggatataatcccctggtgtgccgtttttttaagcccattggaaaagtgcagtattagggtgggagttacccgattttccaggtgccttctgtcacccctttctttgactaggaaagggaactccctgaccccttgctcttcccgagtgaggcaatgcctcgccctgcttcggctcgtgcatggtgcgttgcacccactgtcttgcacccactgtctggcactctctagtgagatgaacgcgatacctcagatggaaatgcagaaatcacccgtcttctgcgtcgctcacgctgggagctgttcctgttcagccatcttagctccacccaccccatgagagaatattcttaaaaccaaatacgtcatagaagcattatgatacatttattgtggaagagaggggtagtttaaacttgtttcatccactgatgttcttattgtagctatgatatttcttaatctgataaaacaatacttataggcaaacgtttctcacttatgtatagatgaaagtatgatttatataaccttgccatacaatagggacccattaattactgaagtaattaatgttttttgagatgtctataatatgttgcagttggtgaagattttagaaagttttatttcggccgggtgtggtcgttcatgcctgtaatccagcacttcgggaggctgaggcgggtggatcacgaggtctggagatcaagaccatcgtggctaatatggtgaaaccctgtgtctactaaaaaaaaaa

SEQ ID NO: 12592 - DNA, 6804 bp, Homo sapiens
ttttttcttgtaaatttgcttaagttctttgtagattctagatattagccctttgtcagatggatagattgcaaaaattttctcccatcctgtaggctgcctgttcactctgatgatagtttcttttgctgtgcagaagctctttagtttatttatatcccatttgtcaattttggcttttcttggcattgcttttcgtgttttagtcatgaagtctttgcctatgcctatgtcctgaatggtattgcctaggttttcttctagggtttttatggttttagatcttacgtttgagtccttaatccatcttgagttaatttttgtataaggtgtaaggaaggggttcagtttcagttttctgcatatggctagccagttttcccagcaccatttattaaatagggaatcctttccccatttcttggttttgtcatgtttgtcaaagaccagatggttgtagatgtgtggtattatttctgagggctctgttctgttccattggtctctatctctgttttggtaccagtaccatgctgttttggttactgtaaacttgtactatagtttgaagtcaggtagcatgatgcctccagctttgttcttttggcttaggattgtcttggctatacgggctgtttaagtttaaagcagtttttttttcaaattctacgaagaaagtcaatggtagcttgatgggcatagcattgaatctatgaattactttgggcaatatggccattttcacaatatggattcttcctatccatgagaatggaatgtttttccatttgtttgtgtcttctcttatttccttgagcagtggtttgtggttctccttgaagaggtccttcacataccttgtaagttggattcctaggtattttattctctttgtagcaattgtcaatgggagttagctcatgatttggctctctgtttgtctgttattggtttataggaatgcttgtgatttttgcacattgattttgtatcctgagactttgctgaagttgcttatcagcttaaggagattttgggctgagatgatggggttttctaaatatacaatcatgtcatctgcaaacagagaaaatttgactccctctcttcctatttaaataccctttatttctttctcttgcctgattgccctggccagaacttccaatactatgttgaataggatccatggtttttttttttaattaaacattttaacatgtttattttgagaaatcagtataaaatgtttcaatattcttttatgtatatctactgtatttcaaaaaatgtttaaaataaataccagaagacaataatttgcctgaagacctgtctcatcaaaaagagaaactgaaattttaaccaaataatttgagttttagtgcatgtgccctgttaaagtaaatagagactgggcctgaagaatccttgggaagacaaagccagttagacctcataaatgaccttaaccttgcttgatttgcaaacataagcaaacattaacttggactatttcttataaatgcctatattagagaaaaaaatgaaacttaaggctaaccaatcagaagccataaattaacttatataactagggactttcctgcaggatacacaaataaggcaactccataactgtacccaatcacatattctccttgctttactttcttattcatcttatgaaggcctccccttgcattccctctgcagaacttttgaaccacttccaatttgaagctgtccaaatcatgaattgctgtttgttcaagtaaaccctttaaaatttttactgtgcccaagtttaccttttgacagttcttaatctttatacttgtatctttttaaaaaattttttttattatactttaagttctagggtacatgtgcaaaacatgcaggtttgttacatatgtatacatttgccatgttggtgtgctgcactcattaacttgtcatttacattaggtatatctcctaatgctatccctcctctctcccccacgacaggccctggtgtgtgatgttccccaccctgtgtccaagtgttctcattgttcagttcccacctatgagtgggatcacatgcagtgtttggttttctgtccttgtgatagtttgctcagaatgatggtttccagcttcatccatgtctctacaaaggacatgaactcatccttttttatggctgcaaagtattccatggtgtatatgtgccacgttttcttaatcaagtctatcattgatggacatttgggttggttccaagtctttgctattgtgaatagtgccacagtaaacatatgtgtgcatgtgtctttatagcagcatgatttataatcctttgggtatatacccagtaatgggatggctgggtcaaatggtatttctagttctagatccttgaggaatcaccacactgtcttccacaatggttgaactagtttgcagtcccaccaacagtgtaaaagtattcctatttctccacatcctctccagcacctgttgtttcctgactttttaatgatcaccatcctaactggtgtgagatggtatctcattgtggttttgatttgcatttctctgatggccagagatgatgagcattttttcatgtgtctgtgggctgcataaatgtgttcctttgagaagtgtctgttcatatcctttgcccactttttgatggggttgtttgattttttcctgtacatttgtttaagttctctgtagattctggatattagccctttgtcagatgggtagattgcaaaaattttctcccattctgcaggttgcctcttcactctgatggtagtttcttttgctgtacaaaagctctgtagtttaattagatcccatttgtcaattttggctttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaaggaatccagtttcagctttctacacatggctagccagttttcccagcaccatttattaaatagggaatcctttccccattgcttgtttttgtcaggtttgtcaaagaccagatggttgtatatgtgtggtattatttctgagggctctgttctgttccattggtctctatctctgttttggtaccagtaccatgctgttttggttactgtagccttgtagtattgtttgaagtcaggtagcatgatgcctccagctttgttcttttggcttaggattgtcttggcaatgtgggctctcttttggttccatatgaactttaaagtagttttttccaattctgtgaagaaagtcattggtagcttgatggggatggcattgaatctatcaattaccttgggcagtatggccattttcaggatactgattcttcctatccatgagcatggaatgttcttccatttgtttgggtcctcttttatttcattgagcagtggtttgtagttctccttgaagaggtcttccacatcccttgtaagttggattcctaggtattttattctctttgaagcaattgtgaatgggagttcactcatgatttggctctctgtttgtctggtattggtgtataagaatgcttgtgatttttgcacattgattttgtatcctgagactttactgaagttgcttatcagcttaaggagattttgggctgagacaatggggttttctaaatatacaatcatgtcatctgcaaacagagacaatttgacttcctcttttcctaatcgaatacactttatttctttctcctgcctgattgccctggccagaacttccaacactatgttgaataggagtggtgagagaaggcatccctgtcttgtgccagttttcaaagggaatgcttccagtttttgtccattcaggatgatattagctgtgggtttgtcataaatagctcttattattttgagatatgtcccatcaatacctagtttattgagagtttttagcatgaagggctgttgaatttaatcaaaggccttttctgcatctattgagataatcatgtggtttttgtctttggttctgtttatatgatggattacgtttattgatttgcatatgttgaaccagccttgcatcccagggatgaagcccacttgatcgtggtggataagctttttgatgtgctgctggattcagtttgccagtattttattgaggatttttgcatcaatgttcatcagggatattggtctaaaattctctttttttattgtgtctctgccaggtttttgtatcaagatgatgctggcctcataaaatgagtgagggaggattccctctttttctattgattggaatagtttcagaaggaatggtaccagctcctctttgtacctctggtagaattcggctttgaattcatctggtcctgaactttttttggttgtaggctattaattattgcctcaatttcagagcctgttattggtctattcagagattcaactgcttcctggtttagtcttgggagggtgtatgtgtcgaggaatttatccatttcttctagattttctactttatttgcatagaggtctttacagtattctctgatggtagttggtatttctgtgggatcagtggtgatatcccctttatcattttttattgcatctatttgattcttctctcttttcttctttattagtcttgctagcagtctatcaatattgttgatcttttcaaaaaaccagctcctgcattcattgattttttaagggttttttgtgtctctatctccttcagttctgctctgatcttagttatttcttgccttctgctagcttttgaatgtgtttgcttttgcttctctagttcttttaattgtgatgttagggtgtcaattttagatctttcctgctttctcttgtgggcatttagtggtataaatttccctctacacactgctttaaatgtgtcccagagattctgatatgttgtgtctttgttcttattggtttcaaagaacatctttatttctgccacattttcgttacgtacccagtagttattcaggagcaggttgttcagtttccatgtagttgagcagttttgagtgagtttcttaatcctgagttctagtttaattgcactgtggtctgagagacagtttgttatgatttctgttcttttacatctgctgaggagtgcttacttccaactatgcggtgaattttggaataagtgcgatgtggtgctgagaagaatgtatattctgttgacttggggtggagagttctgtagatgtctgttaggctcacttggtgcagagctgaattcaattcctgggtatccttgttaactttctgtcttgttgatctgtctaatgttgacagtggggtgttaaagtctcccattattattgtgtgggagtgtaagtctctttggaggtctctaaggacttgctttatgaatctgggtgctcctgtattgggtgcatagatatttaggatagttagctcttcttgttgaattgatcctttaccattatgtaatggccttctttgtctcttttgatctttgttggttcaaagtctgttttatcagagactagaattgcaacctctgcttttttgttttgttttgttttccatttgcttggtagatcttcctccatccctttattttgagcatatgtgtgtctctgcacgtgagatgggtcttctgaatacaacacattgatgggtcttgactctttatccaatttgccagtcttttaattggagcacttagcccatttacatttaaggttattattgttatgtgtgaatttgatcctgtcattatgatgttagctggttattttgctcattagttgatgcagtttcttcctagcatcaatggtctttacaatttggcatgtttttgctggggctggtaccggttgttcctttccatgtttagtgcttccttcaggagctcttgtaaggcaggcctggtggtgacaaaatctctcagcatttccttgtctgtaaaggattttatttctcctttacttatgaagcttagtttggctggaaatgaaattctgggttgaaaattcttttctttaagaatgttgaatattggcccccactctcttctggcttgtagagtttctgccaagacatccacttttagtctgatgggcttccctttgtgggtaacccgacctttccctctggctgcccttaacattttttccttcatttcagctttggtgaatctgacaattatgtgtcttggagctgctcttcttgaggagcatctttgtggcattctctgtatttcctgaatttgaatgttggcctgccttgctaggttggggaagtattgctggataatatcctgaagagtgttttccaacttggttccattatccccatcactttcaggtacaccaatcagacgtagatttggtcttttcacatattcccatatttcttggaggctttgttcatttctttttactcttttttctctaaacatctcttctcgcttcgtttcattcatttgatcttcaatcactgataccctttctcccagttgatcaaatcagctactgaagcttgtgcatgcgtcatgtagttctcatgccatggttttcagctccatcaggtcatttaaggtcttctctacgctgtttattctagttagccattcatctaatcttttttcaagttttaacttctttgtgatgggttcaaacatcctcctttag

SEQ ID NO: 12593 - DNA, 5743 bp, Homo sapiens
ttcatttttctttatttatttttcttttttttattatactttaagttttagggtacatatgcaccacgggcaggtttgttacatatgtatacatgtgccatgttggcgtgctgcacccattaactcgtcatttaacattaggtatatctcctaatgctatccctcccgcctccccccaccccacaacaggccctggtgtgtgatgttccccttcctgtgtccatgtgttctcattgttcaattcccacctatgagtgagaacatgcggtgttcggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttataatcctttaggtatatacccagtaatgggatggctgggtcaaatggtacttctagttctagctccctgaggaatcgccacactgacttccacaatggttgagctagtttacagtcccaccaacagtgtaaaagtgtttctatttctccacatcctctccagcacctgttgtttcctgacttttgaatgatcgccattctaactagtgtgagatggtatctcattgtggttttgatttgcatttctctgatggccagtgatgatgagcattttttcatgtgtcttttggctgcataaatgtcttctttgagaagtgtctgttcatattctttgcccactttttgatggggttctttgtttttttcttgtaaatttgtttgagttcattgtagattctggatattagccctttgtcagatgagtaggttgcaaaaattttctcccattctgtaggttgcctgttcactctgatggtaatttcttttgctgtgcagaagctctttagtttaattggatcccatttgtcaattttcgcttttgttgccattgcttttggtgttgtagacatgaagtccttgcccatgcctatgtcctgaatggtattgcctaggttttcttctagggtttttatggtgttaggtctaacatttaaatctttaatccatcttgaattaattttagtataaggtgtaaggaagggatgcagtttcagctttctacatatgactagccagttttcccagcaccatttattaaatagggaatcctttccccatttcttgtttttgtcaggtttgtcaaagatgagatagttgtagatatgcagcattatttctgagggccctgttctgttccattggtctgtatctctgttttggtaccagtatcatgctgttttggttactgtagccttgtagtatagtttgaagtcaggtagcatgatgcctccagctttgttcttttggcttaggattgacttggtgatgcgggctcttttttggttccatatgaactttaaagtaattttttccaattctgtgaagaaagtcattggtagcttgatggggatggcattgaatctataaattaccttgggcagtatgaccattttcatgatattgattcttcctacccatgagcatggaatgttcttccatttgtttgtatcctcttttatttcattgagcagtggtttgtagttctccttgaagaggtccttcacatcccttgtaagttggattcctaggttttttattctctttgaagcaattgtgaatgggagttcactcatgatttggctctctgtttgtctgttattggtgtataagaatgcttgtggtttttgcacattgattttgtatcctgagactttgctgaagttgcttatcagcttaaggagattttgggctgagacgatggggttttctagatacacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcagagggaatgcttccagtttttgcccattcagtatgatattggctgtggctttgtcataaatagctcttattattttgagatacgtcccatcaatacctaatttattgagagtttttagcatgaagggttgttgaattttgtcaaaggccttttctgcatctattgagataatcatgtggttttttctttggttctgtttatatgctggattacatttattgatttgcgtatgttgaacctgccttgcatcccagggatgaagcccacttgatcatagtggataagctttttgatgtgctgctggattcggtttgccagtattttattgaggatttttgcatcgatgttcatcaggtatattggtctaaaattctctttttttgttgtgtctctgccatgctttggtatcaggatgatgctggcctcataaaatgagttagggaggattccctctttttctattgattggaatcgtttcaaaaggaatggtactagctcctccttgtacctctggtagaattcggctgtgaatccatctgttcctggactttttttggttggtaagctattaattattgcctcaatttcagatcctgttattggtctattcagagattcaacttcttcctggtttagtcttgggagagtgtatgtgtcaaggaatttatccatttcttccggattttctagtttatttgcatagaggtgtttgtagtattctctgatggtagtttgtatttctgtgggatcagtggtgatatcccctttatcatttttaattgtgtctatttgattcttctctcttttcttctttattagtcgtgctaggagtctatcaattttgttgatcttttcaaaaaaccagctcctggcttcattgattttttgaagggctttttgtgtctccatttctttctgttctgctctgatcttagttatttcttgccttctgctagcttttgaatgtgtttgctcttgcttttctagttcatttaattgtgatgttagggtgtcaattttagatctttcctgctttctcttgtgggcatttagtgctataaatttccctctacacactgctttgaatgtgtcccagagattctggtatgttgtgtctttgttctcattttttccaaagaacatctttatttctgcctttatttcattatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgccaaaaaaaatgtatattctgttgatttggggtggagagttctgtagatgtctattaggtccgcttggtgcagagctgagttcagttcctggatatccttgttaactttctgtctcgttggtctgtctaatgttgacagtggggtgttaaagtctcccattattattgtgtgggagtctaagtctctttgtaggtctctaaggacttgctttatgaatctgggtgctcctgtattgggtgcatatatatttaggatagttagctctgcttgttgaattgatccctttaccattatgtaatggccttctttgtctcttttgatctttgttggtttaaagtctgttttatcagagactaggattgcaacccctgcctttttttttttttccatttgcttggtagatcttcctccatccctttattttgagcctatgtgtatctctgcacgtgagatgggtctcctgaatgcagcacactgatgagtcttgactctttatcgaatttgccagtctgtgtcttttaattggggcatttagcccatttacatttaaggttaatattgttatgtgtgaatttgatcctgtcataatgatattagctggttattttgctcgttagttgatgcagtttcttcctagccttgatggtctttacaatttggcatgtttttgcagtggctggtaccggtttttcctttccatgtttagtgcttccttcaggagctcttttagggcaggcctggtggtgacaaaatctctcagcatttgcttgtctgtaaagggttttatttctccttcacttgtgaagcttagtttggctggatatgaaattctgggttgaaaattcttttctttaagaatgttgaatattggcccccacactcttctggcttgtagagtttctgccgagagatcagctgttagtttgatgggcttccctttgtgggtaacccgacctttctctctggctgcccttaacgttttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcagatgtagatttggtcttttcacatagtcccatgtttcttggaggctttgttcatttctttttattcttttttctctaaacttctcttctcacttcatttcattcatttgatcttccatcactgataccctttcttccagttgatcaaatcagctgctgaggcttgtgcattcatcacgtagatctcatgccgtggttttcagctccatcaggtcctttaaggacttctctgcattggttattctagtcagccattcgtctaatcttttttcaaggtttttaacttttttgccatgggttcgaacttcctcctttaggtcggagtagtctgatcgtctgaagccttcttctctcaactcgtcaaaatcattctccatgcagctttgttccattgctggtgaggagccgcattcctttgtaggaggagaggtgcttgatttttagatttttcagtttttctgctctgttttttccccatctttgtggttttatctacctttggtctttgatgatggtgacgtacagatggggttttggtgtggatgtcctttctgtttgttagttttccttctaacagacaggaccctcagctgcaggtctgttggagtttgctggaggtccactccagatcctgtttgcctgggtatcagcagcagaggctgcagaacagtggatattggtgaacagcaaatgttgctgcctgatcgctcctctggaagttttgtctcagaggagtacctggctgtgtgaggtgtcagtctgcccctactggggggtgcctcccagttaggctacttgggggtcaaggacccacttgaggaggcagtctgtccgttctcagatctcaagctgtgcgctgggagaaccgctactctcttcaaagctgtcagacagggacatttaagtctgcagaggtttctactgccttttgtttggctatgccctgcccctagaggtggagtctacagaggcaagcaggcctccttgagctgcggtgggctccacccagttcgagtttcttgactgctttgtttacctactcaagcctcagcaatgacaggcgcccctcccccagcct

SEQ ID NO: 12594 - DNA, 6083 bp, Homo sapiens
taatcatcattcttttttttttttttttttaatttttttttttttattatactctaagttttagggaacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccctttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatgtgggttggttccaagtctttgctattgtgaatagtaccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgcaaacttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagacggttgtagatatgcggcattatttctgagggctctgttctgttccattgatctatatctctgttttggtaccagtaccatgctgttttggttactgtagccttgtagtgtagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagcatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttgttttaattgtgatgttagggtgtcaattttggatctttcctgctttctcttgtaggcatttagtgccataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttccttttcatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacctctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcggggttcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacgtaagcaagcctgggcaatggcgggcgcccctcccccagccttgttgccgccttgcagtttgatctcagactgctgtgctagcaatcagcgacattccgtgggcgtaggaccctctgagccaggtgtgggatatcgtctcgtggtgcgccgtttcttaagccggcctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgagcacggtgcgcacacacactggcctgcgcccactgtctggcactccctagtgagatgaacccggcacctcagatggaaatgcagaaatcacccgtcttctgcgacgctcacgctgggagctgtagaccggagctgttcctattcggccatcttggctcctcctcctaatcatcattcttgaatt

SEQ ID NO: 12595 - DNA, 6049 bp, Homo sapiens
atttacccatttcttttttttttttttatatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatatccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttgtcatgtgttttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaattctttgcccatgcctatgtcctgaatggtaatacctaggttgtcttctagggtttttatggttttaggtctaacgtttaaatctttaattcatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggaatgcggcgttatttctgagggctctgttctgttccattgatctatatctctgttttggtaccagtaccatgctgttttggttactgtagcttgtagtatagtttgaagtcaggtagtgtgatgcctccagctttattcttttggcttaggattgacttggcaatacgggctctttttttggttccatatgaactttaaagtagttttttccaattctgtgaagaaagtcattggtagcttgatggggatggcattgaatctgtaaattaccttgggcagtatggccattttcacgatattgattcttcctatccatgagcatggaatgttcttccatttgtttgtatcctcttttatttccttgagcagtggtttgtagttctccttgaagaggtccttcacatcccttgtaagttggattcctaggtattttatactctttgaagcaattgtgaatgggagttcactcatgatttggctctctgtttgtctgttgttggtgtataagaatgtttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacgctatgttgaataagagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatggaaggttgttgaattttatcaaaggctttttctgcatctgttgagataatcatgtggtttttgtctttggctctgtttatatgctggattacatttattgatttgcatatattgaaccagccttgcatcccagggatgaagcccacttgatcgtcgtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattccgctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttggttcttctctctttttttctttattagtcttgctagcggtctatcaattttgttgatcctttcaagaaaccagctcctggattcattgattttttgaagggttttttgtgtctctatttccttcagttctgctctgattttagttatttcttgccttctgctagcttttgaatgtgtttgttctttcttttctagttcttttaattgtgatattagggtgtcaattttggatctttcctgctttctcttgtgggcatttagtgctataaatttccctctacacactgctttgaatgcatcccagagattctggtatgttgtgtctttcttctcattggtttcaaagaacatctttatttctgccttaatttcgttatgtacccagtagtcattcaggagcaggttattcagtttccatgtagttgagcagctttgagtgggattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcttgggtatccttgttgactttctgtctcgttgatctgtctaatgttgacagtgtggtgttaaagtctcccattattaatgtgtgggagtctacgtctctttgtaggtcactcaggacttgctttatgaatctgggtgctcccgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatatgagatgggtttcctgaatacagcacactgatggatcttgactcttcatccaatttgccagtctgtgtcttttaattggagaatttagtccatttatatttaaagttaatattgttatgtgtgaatttgatcctgtcattatgatattagctggtgattttgctcgttagttgatgcagtttcttcctagtctcgatggtctttacattttggcatgattttgcaggggctggtaccggttgttcctttccatatttagcacttccttcaggagctcttttagggcaggcctggtggagacaaaatgagtcagcatttgcttgtctgtagagtattttatttccccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgtccttaacattttttccttcatttcaactttggtgaatctgacaattttgtgtcttggagttgctcttctccaggagtatctttgtggtgttctctgtttttcctgaatctgaatgttggcctgccttgctagattggggaagttctcctggattatgtcctgcagagtgttttccaacttggttccattctccccatcactttcaggtacaccaatcagacatagatttggtcttttctcatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctgaattttgttcaaagttttcaacttctttgcctttggtttgaatgtcctcccgtagctcagagtaatttgatcgtctgaagccttcttctctcagctcgtcaaagtcattctccatccagctttgttctgttgctagtgaggaactgcgttcctttggaggaggagagacgctctgcgttttagggtttccagtttttctgttctgttttttctccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttgctgctgtctttttgtttgtctgtgccctgcccccagaggtggagcctacagaggcaggcaggcctccttgtgctgtggtgggctccacccagttcgagcttcccagctgctttgtttacctaagcaagcctgggcaatggagggcgcccctcccccagcctcgctgcctccttgcagtttgatctcagactgctgtgctagcaatcagcgagattccgtgggcgtaggaccctccaagccaggtgtggcatatagtctcgtggtgcgccgtgttttaagccagtctgaaaagcgcaatattcgggtgggagtgacccgattttccaggtgcgtccatcacccctttctttgactcagaaagagaactccctgaccccttgcgcttcccaggtgaggcaatgcctcgccctgctttggctcacgcacagtgagcacacccactggcctgtgtccactgtctggcactccctagtgagatgcacccggtacctcagatggaaatgcagaaatcacccgtcttctgtgttgctcacgctgggagctgtagaccggagatgttcctattcggccatcttggctcctccccccgaa

SEQ ID NO: 12596 - DNA, 20024 bp, Homo sapiens
tcctgttattcgtctattcagagattcaacttcttcctggtttagtctcgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctccttttttctttattagtcttgctagcggtctattaattttgttgatcctttcaaaaaaccagctcctggattcattaattttttgaacggttttttgtgtctctatttccttcagttctgctctgattttagttatttcttgccttctgctagcttttgaatgtgtttgctcttgcttttctagttcttttaattgtgatgttagggtgtcaattttggatctttcctgctttatcttgtgggcatttagtgctataaatttccctctacacactgctttgaatgtgtcccagagattctggtatgttgtgtctttgttcttgttggtttcaaagaacatctttgtttctgccttcatttcgttatgtactgtacccattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgctgaaaagaatgtatattctgttgatttggggtggagagttctgtagatgtctattaggtccacttggtgcagagctgagttcaattcctgggtatccttgttgactttttgtctcgttgatctgtgtaatgttgacagtggggtgttaaagtctcccattattattgtgtgggagtctaagtctctttgtaggtcactcaggacttgctttatgaatctgggtgctcctgtattggttgcatatatatgtaggatagttagctcttcttgttgaattgatccctttaccattatgtaatggccttctttgtttcttttgatctttgttggtttaaagtctgttttatcagagactagtattgcaacccctgcctttttttgttttccatttgcttggtagatcttcctccatccttttattttgagcctatgtgtgtctctgcacgtgagatgggtttcctgaatacagcacactgacgggtcttgactctttatccaatttgccagtctgtgtcttttaattggagcatttagtccatatacatttaaagttaatattgttatgtgtgaatttgatcctgtcattatgatgttagctggttattttgttcgttagttgatgcagtttcttcctagtcttgatggtctttacattttggcatgattttgcagtggctggtaccggttgttcctttccatgtttagtgcttccttcaggagctcttttagggcaggcctggtggtgacaaaatctctcagcatttgcttgtctgtaaagtattttatttctccttcactgatgaagcttagtttggctggatatgaaattctgggttgaaaattcttttctttaagaatgttgaatattggcccccactctcttctggcttgtagggtttctgccaagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaacctgaacgttggcctgccttgctagattggggaagttctcctggataatatcctgcagagtgttttccatcttggttccattctccccatcactttcaggtacaccaatcagatgtagatttggtcttttcacatagtcccatatttcttggaggctttgttcgtttctttttattcttttttctctaaacttcccttctcgcttcattttattcatttcattttccattgctgataccctttcttccagttgatcgcatcagctcctgaggcttctgcattcttcacgtagttttcgagccttggctttcagctccatcagctcctttaagcacttctctgtattggttattctagttatacatttgtctaaatttttttcaaagttttcaacttctttgcctttggtttgaatttcctcctgtagctcggagtagtttgatcatctgaagccttcttctctcaactcgtcaaagtcattctccatccagctttgttccattgctggtaaggaactgcgttcctttggaggaggagaggcgctctcctttttagagtttccagtttttctgctctgttttttccccatctttgtggttttatctacttttggtctttgatgatggtgatgtacagatgggtttttggtgtggatatcctttctgttgttagttttccttctaacagacaggaccctcagctgcaggtctgttggagtttgctagaggtccactccagaccgtttgcctgggtatcagcagcggtgtctgcagaaccacggattttcatgaaccgcgaatgctgctgtctgatcgttcctctggaagttttgtctcagaggagtacctggccatgtgaggtatcagtctgccccactggggggtgcctcccggttaggctgctcaggggtcagggacctacttgaggaggcagtctgcccattctcagatctcaaactgcgtgctgggagaaccactgctctcctcaaagctgtcagacagggacatttaagtctgcagaggtttctgagcctacagaggcaggcaggcctccttgagctgtggtgggctccacccagttggagcttcccggctgctttgtttacctaagcgagcctgggcaatggcgggtgcccctccgccagcctcgctgcagccttgcagtttgatctcagactgctgtgctagcaatcagcaagactccgtgggcgtaggaccctccgagccaggtgcgggatataatttcctggtgcaccgtttcctaagcccgtcggaaaagcgcagtattcgggtgggagtggcccgattttccaggtgccatctgtcacccctttccttgaccaggaaagggaactcccggaccccttgcgcttcccgtgtgatgcgatgccacgccctgcttcggctggcgcacggtgcgctgcacccactgtcctgcacctactgtctggcactccctagtgagatgaacccggtatctcagatggaaatgcagaaatcacccgtcttctgcgtcgctcacactgggagctgtagaccggagctgttcctatttggccatcttggctcctcccacttcttcctttataaaacggtatgtcttttattgctttctatttacattactgcatggctaggaactccagtgcaatgtgggatagaagtggtaagagtggcatccttgccttgttcctgatctttggagataaccaaggttttcatcgttaaatatgacgtgagctgtaagtttttcacagatgtcctttgtcagatgtcttttattcctagtttgatgagttttatcatgaatgagtactgaattttctcacaagctttttctgcactattggcatgatcatatggtttatttagttacattgattgagtcaatctggaataatgccatttggtcatgatttacctctttcttatattgatagaattgatttgctaatattttgtgaggatttttacatcaatgttcatggaggatattggtctttagttttctttcttttaattttttttttttatgagacagtctcactctgtcaccgaggctggagtgcagtggcacgtctcagcccactgcaacctctgcctcttgggttcaagtgattcttgtgcctcagccacctgagtagctgggattacaagcatgtgccactacacccagctaatttttttttttaaatctttggtagagatggggtttcaccatattggccagggtctcaaaatcctgacttaaaagtgatttgccaccttggcctcccaaagtgctgggattacagatgtgtgcccggcatctttcttgtaattctctgtctggttttgagtatgctggcttcataaaatgggttattctaatattatgaagagtttttgtagaattggtatcatttcatagatggcactgacttaccacaattattttctgtgtttttgtccttttcatctttgaaatgcctgtgaagtccacttgtccatgatgctttacactgcaatgatttaaaataaatctggcaaacagctaatttcctttttctgtcttaaaacctttgcaactctcataatcatggaaatctaaaaacactgtttaagaaataagaattattggccaggcacagtggctcacgcctgtaatcccagcactttggggtgctgaggcgggcatatcactgaggtcaggagtttgagaccagcctggccaacatggtgaaaccctgtctctatgaaaaatacaaaaattagctggacatggtggtgggcacctgtagtcccagctacttgggaggctgaggcaggggaatcgcttgaacctgggaggcagaggttgcagtgagccgagatcgtgctgctgcactccagcctgggcgacagagcgggactccatctcagaatgaatgaatgaatgaatgaatgaatgaatgaataaaatttagtgttacaaagagttataagtttatattaaatattcaaacactacagtagggaacattttgggtagttttcaagtaacctaacgttacgatctcctaacaaggttaacaacaatacacagaatcaggttttgaaaccgtcaattgaaggacattttttgtttctaaaacttagaataccatttataggatttgtgtaaaatatacaatgcttctacttgtaagagtcacccacacccattatgtctgctactcaaaacataaaaacagaaaataagtgttgataaggatgttgagaaattgcaacccttgtgcactgatggtggagttgtaaaatggttcggccactgtggaaaaacagtatggtggctccttaaaaagttaaaaatagaatgactatatgatccaacaattccgtttctgggtataaagaaaaaagagttctgaagacatatttgtatacccatgtaaatagtgacaatattcacaatagtcaaagggtagagacaactctagtatccactgatggatgaatggataaataaaatatatacagtatatacacatacacaatggaatattattcagccttaaaaaggaaggaaattctgcaatatattacaacatagacgaaccttgaggacattatgctaagtgaaataagctagtcacaaagagacaaatattgcatgattctacttataaaaggtacagtaccttgaatgtcaaatgcagagagacaaaaggtagaacagtagttctcaggggctggttgaatagaggagtggggagttgtttaatgggtatagaattttagttttgtaaggttaaagaagtgctggaggttggttgcacaccactggaaatgtattttatcgctactgaaccgtatacttaaaaacgagatggtaaattttgttgtgtgtgtgtgggtgtttttaagtgactcaccattagtagtataccagctatgaacacacacttatatcatggcaagaactaataagcaagatcatgaccacttctctcctatgtttctgtcccagtatgggaatactgaccttaacctttaatactatgtctcagtgttcagtgctgtttgtgttgctggattccttcaaatcagcaatgtgtttatgttgattgctaagctttaattctcaccggagaattataatatctttcctattttcctgattttattactgatttttcttgggattcaaaatttgggaaaacaaaaagtttctcaagaaatgctggaaaggaaatcccacttggaaacactaaccaaaacgtttgcaagcaaaataaagcaatagataaaatggatcagttgaggttatactaggagtataagatgatttaaccttagaaaatcaaacagtgtagttcactacattaacagattcaaggaaaataatcatcatcaataaatgcagataaactgctaaaattcaccatctgtaataaaacctcacagcagcctagggacagaaaggaacttctttaatctgataagggaaatacacacattaaaaaaaaaaaaaacaaaaccctgcagcaaacagtaaatttaaaggtaaacacttacacttttatctttgagatgaggcacaggactagaatgtcccaatattctactgatgattgtgctaaagagaggtcctagccagtaaaatgaggcaaggaaaaaaaaaaagcaaacagtatagattggaatatgatctaacaattccatttctgacattattcatagatgatatgattatatacatagaaaatccaaacattactcatagatgatatgactatatatatagaaaatccaaaagaatccagatatatttctagaaagaattaaaagagcttactgtggttactggatagaaaaatcaatatgtaaaaactaattttaattctaacagtaataattaggaaaaacttatgaaaaaaatgtcctttataagaacatttaaaaaaacaaagtgcttaggaataaacatagtaaaactatacaagatctctgcaaggaaaactaaaacttaactgagtgacattaggaacaagggaaaatccctacctgaaagatttaaccttaatgaaaacactaataaaaatgtctgtcaaccaaaaaaactccattaagagaatgaagagacaagctacagaattggaaaagatgttagctaagatgttacataaccaacaaaggatcagtagaaatatcagcaaagaatacgtacaggcagttcatcagagaaaatcatactgactaacaagtgtatactaaaacatttaatctccctagtaattagtgaggtacaaattaaaatgagacatgataccattttgttcccatcaaaataacaataactttattttgaaaatatcaagtgaggcagcaaaatcacccctggttaagaaccactgcttttggatcatacacaatgaaagtatatatttctacatactgttgtacataaaactgtgtatgctgtacttttaatggcaaagggatttttcagaggataatgtctattatgagatctccttacttaccaaattctgagtcattataatctttgtggaaactttgactccactatatttatgcaaaatgcattttgttaaaatctaggcaaaagagactaaaactccagaggactgaatttattttaaaaatatgataaacaggtaaaaaactttgcatttaggataccaggatctttgcacttgtcatattctagtacagatcttttaggctagaaatgtcaactagatcactttctaggcccaaagaaagaacattcatatttgcctttttgtcaggaggcgactaagaaacactactaggatatttagactgagatgcagcattatcagactggttgtgcaataggctccccggttcacactgcgtggtcagttgcctatcctcctcagattgggagctttatataggcagactatgcctgccttgctcactgctttctccttagaacgagtcccatgcctggcacacagaacacacaaatatttgaataaagtgaatgagtcttagtatatgcttttagaattatttattcaaaaacactttataataaattcaggtaacagtaaagtaatacattcaatagtactaaaatctatagaaaatagataatttcattaaggtgcaattaaaatacttgaaattgggacacatctctatatttcaaaccaatatactggctttctttttaaaagactattctagtctttacgatgtccaaagtttttcctctttgcttttatttgctttagaccatatttaaatttttagcattcctaagtgcatacattttaggcatatactataatgaccaagagtttgtgaacctactgattaggtaaacactttggggaggtatgacctgcacaaagtagggtgggaaagctattatctcccttaatctggacacaactgttcaagcagtctataatttattagcttctctgatagcttcactatttggttttcattgaccttttgagcaactgactggcaaaccccagattcttttcgcctgaaatcttttcaagttagatactgtccatattacacttgtacttataatttactatcttcttgccttggacaacttatttctccaaattctgatttctccagcagtgtattgggatagtatcactaatcttgcaaagtaaagatcagaaatgctgtacataatatgggtcagtgacttagcatacaacaactattctatgattaatattttcaaaatctaactactcctcatttgtccttggcagttttctatcttagtcatttgcagaaagagttccagcttgccaaaacctttttttttttttttttgaggcagagtcttgttctgtcgccaaggctggaatacaatggcaaccctgtctttactaaaattacaaaaaaaaaatcttttataatcttaattctgtcatctgtgaattagttatttctcctaggcttgtgatctgtatgtaaatttgataaacttttcaaagccattgattagaatacttgaacagaacaggagcctcatagcataccatgcaaggctaaagagtagattaatgatgttattcaaagctctctggatgcaacaactagcaagaattagctacaaattcatttatctatactattatctagttgataatttctaatttcacccatgaagatttcagggctttcttaaagacattttaagtttactgcatttccttgatttactatagtaataaaactaccaatatataccaaatattcatttaggcagcttgtaagaaaaagatacaccaaggtaagtttgtaatttgaaatgcaaagtaatattctgaacagttctccagaagtcaaaccaagaaatttatagtccaaaaagttctggagattggttttaggggaggggaaggtgaggagatcaaatatgaatgagtgcctgccattggcaataaaaagaaatgccaactcttcataagaaaaaaatttatataaccttcaaggtccaaatacgaggagaaagctcaatcacccatttgttaatctccgcagctgggatgaacattttcctaaggatggagaagagattatactcactaatacacgagtcagtagttttactttcaggtggctttttatctgatgtttatcttatatgatgacagctgggggacagagaaatgttccacttctacctatgtatcaaactagatacctaagcccttcccttccaacagaacacagagaaatgctggataaaatgtagaaaacattcttttaaatacatagcagaacttacaagaaaggggaaatccttacggtcaaaaatgaggggaatgaggccgggcgcggtggctcacacctgtaatcccagcactttgggaggccgaggagggtggatcacgaggtcaagcgatcgagaccatcctggctaacacggtgaaactccgtctctaataaaaatacaaaaaattagccgggcgtgttggcacacgcctgtagtcccagctactcaggaggctgaggcaggagaattgcttgaacccaggaggcagaggtttcagtgagctgagatcatgccactgcactccagcctgggtgacagagcaagactctgtctcagaaaaaaatgaggggaatgaaaaaccagagaggtgaatatgtgagctgatgctgtagctgtcctggaacaatttgccagtctcattaacccacggcttttagcttagacatctatatggggagcaaagaacccagggcttgccaaaggcaggcagtgggaattaaatgtacctccttccacccctgccataaaggtgggacacatggaagcttatactctcagtgaaaaaggcatcaatcaaatattctgcccactagcacaaggagatgaggaggaagtgtgtttgccttggcctgggaaatctcctatcagtatttatgctacacttcaggtatggaaaccctaaagccaagaaattaaaataagaatgggcttgtgtgcagcaacagccctgggaatatgacataaacagacactcaagattcccatagataaagccttgctgaaaataaactcacttttcaaaaagacaaaactggatgaacagcctatcaaatacaaaaatcaacagatataaacagcaggaactaaatttaatagaactattacagtgtctatcaagtacagacatttaaaataattagtgacataaaaaacattaaaaaaacattaaaaatgacatcaagaaacagagatctgaaaaatgatgcataattagaaatgaaaaacaatttctgaaagaagaagcccaatggatagggtaaaagagattatatacatctgacaagagaattcatgaactagaaggcaatctatgaagttatcacagaaagataacatacatggacagtacagaagggcttaaaagataaagagaatagaatgagaagttttaatacacacttaaaaaaatagtaactacactaactgtgtctttgaaatttgttctccataacaacttcattatttagtaacactgagtgatcttactaggaaaaatccaaataagtttctgttttttttttttttttttgagatggagtttcgctcttgtcacccaggctggagtgcaatggcatgattttggcccacagcaaccttcacctcccaggttcaagagattctcctgcctcagcctctcgagtagctgggattacaggtgcccgccaccatgctcggctaatttttgtatttttagtagagacagggtttcaccatactggccaggctggtctcttggccaggctggtctcgaactcctgaccttgtgatccgctcacctcggcctcccaaagtgctgggattacaggcgtgagccgctgcgcccagcccgaatgaccattatttctaaagagtgaaagcagagatgttccttaagaccatcaaaacatttttgagtggtgattaaatcaagtattaaaaccaacattcaaaaaaacccacaatagttcacttaaatattaatccctacttaaagtatgttggcaggttaaaaataaaggctaaaatataatttctaaaggctgaatgaaagggtaattcatatactgaagatcacacccaagctttccatcctgggaaaagtcggctgagatttttggggtctatggcctgctgtatgagcaaattcacttgtccaccaacactgagcacagtgccttcttccactcctttcagtttctcttgtagtctcattaagacacgttcagctactttgttgaaactctggtcaatatcactaaggacaaaaacacaaaggtttcagtgaggtgaacagtttaaaggccttgggaataagaaaatctgaaaaactgacaacaggaccttcttaaaatactgctcacctgagatttcgtttgcattcttggtcatctgcattcagagtagggtgaagctcagtttcatcttccggcctctgctgtaaatacaaagctttcaaaggattcatggtccagtcaaagagtggatcatatagaaggacctaaacagagagaacatatgtattaaaagaacaatgtacattttaatcacatacttagaaacagtagaaccagtatcatacaaataagccagtcacatggtagttgatgggggaggggaacaaacatcatgcacacttcatgtttccttgaggaaactatcctagcataatgctccaagcttctcatttcattctgaattcattcttcctccatggttaggggtgacatcccttgacccatgtttcctgactggatgaaactaatctattaaaaggttagtcactttctttccttctctctctactcttaaccctgggttagtgtatttgctttgtagggcccaattcttcctcagcccaggctgtctcaaggtatagattgggatgtgggaactggagagcaccagcaagcctatttggacctcactcctaagccgtcttctccaatagttttatcagtaacaaatctgaaattctgatctccaccctattcctatggctctttttctctcagttctaaatctgggtggatccagaaaggtataatttgttgaaacctcctcaaaacccaaggtttggtgctgcgtttggaatcttgagatatatattaggtgtagaattaggataccaaaacaactgacatggctagagcaagtagctttaggtcgtaaattttagaaagtgagttcatgaggaatttctgatattggcagttcagaacagctaactgctctggtatttataaacacagaactttaaaaaaaataggctttagcaaatgcttacaaatcttagtaataagtggagacaatataaagaatgattctacagggcattccagtattacaaggttggaacacttttttgctgctatctgtatacagtttctcagtaaatctgcaggttgggactataaaatgcctttagcagatttagtttcaggacacgtactagattagcagaaccaaaatcgctctattttttaatgctgttttgagtgtcctccaggaccattaaatactgtggagaaactgagcttgattacatgtagcttgtccgttaagttcaaggtttcctatgtgacttcaagttgggcactgacatggctttagatttcagagatccaaaccagtttcacccacaaaagggaaatattaatatattttattaatgaactaatgaaaaggaatgaaggcctctaatacagactagatggttttcttgggttgaagtagaagaaaaatctaaattacttcaaaaccaagggcttgtgtcaggaatcatacttgcaaatattagaattaaggaggaactggaataagtaaaaaattatgtttcagtctgacaagacagaagtggttggaaacagtaaaggaatacagactgattaagctagagcagggtttctcagtctcagcactattgtcattttggatggggtatttctttgctgtgggggctaacttgtacattctgaggtgttcagcagcatccctggcctctacccagtagatgccaatactatcctcatctcccatccccaattgtgacaataaaaatgcctccagacattgccaactgtcctctaggggacaaaactgctcttggctaagcatcactgagttagagggagagatatatttccttagcataacacataaaatcttagaggagagaatggtccattaggaagaaaataaaatcttgaaggccaggagagacaaatacactgaaaagaaaagggaaatacacccaggttaaagtgctctgaaggaggggcttaggaagcggggagatcagttcagaaatagtgactgtgcctcaatgaaatctaagagaagaaaagaaatgaatccaagagaggaaagatatgatgtcccagaggactgggaaccaggatgctaattgagaagcaccctcctaaagctgaaggcagaaagggtcttactgtggtaagatcactgggaaaattattcttgaagattggaacaatcacaccaaatgattttgggaaattcggacagatttacggagggaagattaggtagatgagtgtaaaatacacaaagcattggagggtgtgttttttttgtttgtttgttttgttgtttgtttttttagttttttttaaattatacttttatgttttagggtacatgtgcacattgtgcaggttagttacatatgtatacatatgccatgctggtgcgctgcacccactaactcgtcatctagcattaggtatatctcccaatgctatccctccccccaccccccaccccaccacagtccccagagtgtgatattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgccgcaataaacatacgtgtgcatgtgtctttatagcagcatgatttatagtcctttggttatatacccagtaatgggatggctgggtcaaatggtatttctaattctagatccctgaggaatcgccacactgacttccacaatggttgaactagtttacagtcccaccaacagtgtaaaagggttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggtattaggtctaacgtttaagtctttaatccatcttgagttaatttttgtatcaggtgtaaggaagggatccagtttcagctttctacatatggctaaccagttttcccagcaccatttattaaatagggaatcctttccccattgcttgtgtttctcaggtttgtcaaagatcagatagttgtagacatgcggcgttattcgaacggctctgttctgttccattgatctatatctctgttttggtaccagtaccatgttgttttggttactgtagccttgtagtatagtttgaagtcaggtagtgtgatgcctccagctttgttcttttggcttaggattgacttgccgatgcgggctcttttttggttccatatgaactttaaagtagttttttccaattctgtaaagaaagtcattggtagcttgatggggatgccattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtaaaagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggtttttgaattttgtcaaaggctttttctgcatctattgagataatcatgtggtttttgtctttggttctgtttatatgctggattacatttattgatttgcatatattgaaccagccttgaatcccagggatgaagcccactggatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttgtttggtaaactattgattattgccacaatttcagctcctgttaactggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttctttattagtcttgctagcggtctatcaattttgttgatcctttcaaaaaaccagctcctggattcattaattttttgaagggttttttgtgtctctatttccttcagttctgctctgattttagttatttcttgccttctgctaacttttgaatgtgtttgctcttccttttctagctcttttaattgtgatgttagggtgtcagttttggatctttcctgctttctcttgtgggcatttagtgctataaatttccctctacacactgctttgaatgtgtcccagagattctggtacgttgtgtctttgttctcgttggtttcaaagaacatctttatttctgccttcatttcgttatgtatccagtagtcattcaggagcaggttgtttggtttccatgtagttgagcggttttgagtgagattcttaatcctgagttctagtttgatgtcactgtggtctgagagatagtttgttataatctctgttcttttacatttgctgaggagagctttacttccaactatggggtcaattttggaataggtgtggtgtggtgctgaaaaaaatgtatattctgttgatttggggtggagagttctgtagatgtctattaggtccgcttggtgcagagctgagttcaattcctgggtatccttgttgactttttatctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttgttgaattgatccctttaccattatgtaatggccttctttgtttcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatatacatttaaagttaattttgttatgtgggagtttgatcctgtcattatgatgttagctggtgattttgttcgttagttgatgcagtttcttcctagtctcgatggtctttacattttggcatgattttgcagtggctggtaccggttgttcctttccatgtttagtgcttccttcaggagctcttttagggcaggcctggtggtgacaaaatctctcagcatttgcttgtctgtaaagtattttatttctacttcactgatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcaaagagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctgaacttcccttctcgcttcatttcattcatttcatcttccatcgctgataccctttcttccagttgatcgcatcggctcctgaggcttctgcattcttcacatagttctcgagccttgattttcagctccatcagctcctttaagcacttctctgtattggttattctagttatacattcttctaaatttttttcaaagttttcaacttatttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttccagtttttctgctctgttttttccccatctttgtggttttatctacttttggtctttgatgatggtgatgtacagatgggtttttggtgtggatatcctttctgtttgttagttttccttctaacagacaagaccctcagctgcaggtctgttggagtaccctgccgtgtgaggtgtcagtgtgcccctgctggggggtgcctcccagttaggctgctcgggggtcaggggtcagggacccacttgaggaggcagtctgcctgttgtccgatctccagctgcgtgctgggagaaccactactctcttcaaagctgtcagacagggacatttaagtctgcagaggttactgctgtctttttgtttgtctgtgccctgcccccagaggtggagcctacagaggcaggcaggtctccttgagctgtggtgggttccacccagttcgagcttccaggctgctttgtttacctaatcaagcctgggcaatggcgggcgcccctcccccagcctcgctgccaccttgcagtttgatctcagactgctgtgctagtaatcagcgagactccgtgggcgtaggaccctccgagccagctgcgggatataatctcgtggtgcgccgttttttaagctggtccaaaaagcgcaatattcgggtgggagtgacccgattttccaggtgccgtctgtcacccctttctttgactaggaaagggaactccctgacccttgcgcttcccaagtgaggcaatgccttgccctgcttcagttcgcgcacagtgcgtgcacccactgacctgcgcccactgtctggcgctccctagtgagatgaacctggtacctcagatggaaatgcagaaatcacctgtcttctgcatcgctcacgctgggagctgtataccggagctgttcctattcggccatcttggctcctcctcc

SEQ ID NO: 12597 - DNA, 12541 bp, Homo sapiens
tttattttattttattattattatactttaagttttagggtacatgtgcacagtgtgcaggttagttacatatgtatacatttgtcatggtggtgtgctgcacccattaactcgtcatttagcattaggtatatctcctaatgctatccctccccatccccccacaacagtccccggagtgtgatgttccccttcctgtgtccatatgttctcattgttcaattcccacctatgagtgagaatatgcagtgtttggttttttgttcttgtgatagtttacgagaatgatgatttccaatttcatccatgtccctgcaaaaggacatgaactcatcattttttatggctgcatagtattccatggtgtatatgtgccacattttcttaatccagtctatcattgttggacatttgggttcgttccaagtctttgctattgtgaatagtgccgcaataaacatatgtgtgcatgtgtctttatagcagcatgatttatagtcctttggatatatacccagtgatgggatggctgggttaaatggtatttctggttctagatccctgaggaatcgccgcactgacttccacaatggttgaactagtttacagtcccaccaacagtgtaaaaatgttcctatttctccacatcctctccagcacctgttgtttcctgacttttaaatgattgccattctaactggtgtgagatggcatctcattgtggttttgatttgcatttctctgatggccagtgatgatgagcattttttcatgtgttttttggctgcataaatgtcttcttttgagaagtgtctgctcatatactttgcccactttttgatggggttgtttgttttttccttttaaatgtgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggctttggttgccattgcctttggtgttttagacatgaagtccttgcccatggctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgctcatttttctcaggtttgtcaaagatcagatagttgtagatatgcagcgttatttctgagggctctgttctgttccattgatctacatctctgttttggtaccagtaccatgctgttttggttactgtagccttatagtatagtttgaagtcaggtagcgtgatgcctccagctttgttcttttggcttaggattgacttggcaatgcaggctcttttttggttccatatgaactttaaagtagtttttccaattctgtgaagaaagtcattggtagcttgatggggatggcattgaatctataaattaccttgggcagtatggccattttcacgatattgattcttcctacccatgagcatggaatgttcttccatttgtttgtatcctcttatttcattgagcagtggtttgtagttctccttgaagaggtccttcacgtcccttgtaagttggattcctaggtattttattctctctgaagcaattgtgaataggagctcactcatgatttggctctctgtttgttattgctgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaaatgaatactctttatttccttctcctgcctgattgccctggccagaacttccaacactgtgttgaataggagtggtgagagagggcatccctgtcttgtgccagttttcaaagggaatgcttccagtttttgccctttcagtatgatattggctgtaggtttgtgatagatagctcttatcattttgaaatatgtcccatcaatacctaatttattgagagtttttagcatgaagggttgttgaattttgtcaaaggccttttctgcatctattgagataatcatgtggtttttgtctttggttctgcttatatgctggattacatttattgattttcatatattgaaccatccttgcatcccagggatgaagcccacttgatcatggtggataagctttttgaggtgctgcttgattcagtttgccagtattttattgatgatttttgcaccaatgttcatcaaggatattggtctaaaattctctttttttgttgtgtctctgcctggctttgatatcaggatgatgctggcctcataaaatgagttagggaggattccctctttttctattgattggaatagtttcagaaagaatggtaccaattcctccttgtacctctggtagaattcagctgtgaatccatctggtcctggactctttttagttggtaagctattgattattgccacaatttcagagtctgttattggtctattcagagattcaacttcttcctggtttagtcttgggagggtgtatgtgtcgaggaatttatccatttcttctagattttctagtttatttgtgtagaggtgtttgcagtattctctgatggtagtttgtatttctgtgggatcggtggtgatatcccctttatcattttttattgcgtctatttgattcttctctcttttttctttattagtcttgctagcggtctatcaattttgttgatcctttcagaaaaccagctcctggattcattaattttttgaagggttttttgtgtctctatttccttcagttctgctctgattttagttattttttgccttctgctagcttttgaatgtgtttgctcttgcttttctagttcttttaattgtgatgttagagtgtcagttttggatctttcctactttctcttgtgggcatttagtgctataaatttccctctacatactgctttgaatgtgtcccagagattctggtatgttgtgtctttgttctcgttggtttcaaagaacatctttatttctgccttcgtttggttatgtacccagtagttattcaggagcaggttgttcagtttccatgtagttgagcggttttgagtgagtttctgaatcctgagttttagtttgattgcactgtggtctgagagagagtttgttataatttctgttcttttacgtttgctgaggatagctttacttccaactatgtggtcaattttggaataggtgtggtacggcgctgaaaaaaatgtatattctgttgattttggggtggagagttctgtagacttctattaggtctgcttggtgcagagctgagttcaaatcctgggtatccttgttgactttctgtctcgttgatctgtctaatgttgacagtggagtgttaaagtctcccattattattgtgtgggagtctaagtctctttgtaggtcactcaggacttgcattatgaaactgggtgctcctttattgggtgcatatatatttaggatagttagctgttcttgttgaattgatgccttgaccattatgtaatggccttctttatctcttttgatctttgttggtttaaagtctcttttatcagagactaggattgcaacccctgactttttttgttttctattttcttggtagatcttcctccatccttttattttgagcctatgtgtgtctctgcacatgagatgggtttcctgaatacagcacactgacgggtcttgactctttatccaatttgccagtctgtgtcttttaattggagcatttagtccatttacttttaaagttaatattgttatgtgtgaatttgatcctgtcattttgatgttagctggttattttgctcgttagttggtgcagtttcttcctagcctcgatggtctttacaatttggcatgattttgcagtggctggtaccagttgttcctttccatgtttagtgcttccttcaggagctcttttagggcaggcctggtggtgacaaaatctctcagcatttgcttctctgtaaagtattttatttctccttcacttatgaagcttagtttggctggatatgaaattctgggttgaaaattcttttctttaagaatgttgaatattggcccccactctcttctggcttatagagtttctgccgagagatccgttgttagtctgatgggcttccctttgtgggtaacccgacctttctctctggctgcccttaacattttttccttcatttcaactttggtgaatctgacatttatgtgtcttggagttgctcttctcgaggactatctttgtggtgttctctgtatttcctgaatctgagtgttggcctgccttgctagattggggaagttctcctggataatatcctgcaggctgttttccaacttggttccattctccccgtcactttcaggtaaaccaatcagacatagatttggtcttttcacatagtcccatatttcttggaggctttgtttgtttcttttaatttttttttctctaaacttcccttcttgcttcatttcattcatttcatcttccatcgctgataccctttcctccagttgatcgcatcagctcctgaggcttctgcatccttcacgtagttctcgagccttggctttcagctccatcagctcctttaagcacttctctctattggttattctagttatacattcgtctaaatttttttcaaagttttcaacttctttgcctttggtttggatttcctcctgtagctcggagtagtctgatcgtctgaagccttcttctctcaatttggcaaagtcattctccgtccagctttgttccattgctggtgaggaactgtgttcctttggaggaggagaggcactctgctttttagcgtttgcagtttttctgctctgttttttccccatctttgtggttttatctacttttggtctttgatgatggtgacgtacagatgggtttttgatgtggatgtcctttctgtttgttagttttccttctaacagacaggaccctcagctgcaggtcttttggagtttgctagaggtccactccagaccgtgtttgcctgggtaacagcagtggtggctgcagaacagcagattaccgtgaaccacgaatgctgctgtctgatcgttcctctggaagttttgtctcagaggagtacctggccttgtgaggtgtcagtctgcccctactggggggtgcctcccagttaggctgcttggaggtcaggggtcagggacccacttgaggaggcaatctgcccattctcagatctccagctgcatgctgggagaaccactgctctcttcaaagctgtcagacagggacatttaagtctgcagaggttactgttgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccctagccttgctgccgccttgcagttggatctcagactgctgtgctagcaatcagcgagactttgtgggcgtaggaccctccgagccaggtgcgggatataatctcctggtgtgccattccttatgcccgtcggaaaagtgcagtattagggcgggagtgacccaattttctaggtgctgtctgtcacccctttctttgagtaggaaagggaactccctgaccccttgcacttcccgagtgagacaatgcctcgccctgctttgactcgtgcacggtgcactgcactcactgtcctgcgtccactgtctgccactccctagtgagatgaatccggtacctcagatggaaatgcagaaatcacccgtcttctgtgtcgcacatgctgggagctgtagaccggagctgttcctattcggccatcttggctgctgcctctgaaatttcctaaagaagaaggaattctcctgaagactgcaatgtagaaaccctgcctgagtttccagcctgatgctctggaatttggactcaagactgcaaactcaactctttcctaaattcccagcctggtagctcagcctgccctgcaagtttgggacttgacagcctcaagatcacatgacaatttctttttttttttttttttttactacatcattaagacttatttaatgctgagtctaaatacaaatccaagtgccccgtctgttcccataaaaatgttcatatttgtgttcttttttttttttttttactttgtgttttgttacttttaccttttctttctttttttttattattatactttaagttttagggtacatgtgcacattgtgcaggttagttacatatgtatacatgtgccatgctggtgcgctgcacccactaactcgtcatctagcattaggtatatctcccgatgctatccctccctgctcccccgaccccacagcagtccccagagtgtgatattccccttcctttgtccatgtgatctcattgttcaattcccacctacgagtgagaatatgcggtgtttggttttttgttcttgcgatagtttactgagaatgatgatttccaatttcatccacatccctacaaaggacatgaactcatcattttttatggctgcatagtattccatggtgtatatgtgccacattttcttaatccagtctatcattgttggacatttgggttggttccaagtctttgctattgtgaataatgcagcaataaacatacgtgtgcatgtgtctttatagcagcatgatttacagtcctttggatatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttaaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggttattagccctttgtcagatcagtaggttgtgaaaattttctcccattttgtaggttgcctgttcactctgatggtagtttcttttgctgtgcagaagctctttagtttaagtagatcccatttgtcaattttggcttttgttgctattgcttttggtgttttagacatgaagtccttgcccatgcctatgtcctgaatggtaatgcctaggttttcttccagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattggttgtttttgtcaggtttgtcaaagatcagaaagttgtagatatgcggcgctatttctgagggctccgttctgttccattgatctatatctctgttttggtaccagtaccatgctgttttggttactgtagccttgtagtatagtttgaagtcaggtagtgtgatgcctccagctttgttcttttggcttaggattgccttggcaatgcgggctcttttttggttccatatgaactttaaagtagttttttccaattctgtgaagaaagtcattggtagcttgatggggatggcattcaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttatacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccggttttcaaagggaatgcttccaatttttgcccattcagtatgatattggctgtgggtttgtcatagatagctcttatcattttgaaatatgtcccatcaatacctaatttattgagagtttttagcatgaaccgttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaagatattggtctaaaattctctttttttgttgtgtctctgcctggctttggtatcagaatgatgctggcctcataaaatgagttagggaggattgcctctttttctattgattggaatagtttcagaaggaatggtaccagttcctccttgtacctctgttagaattcggctgtgaatccatctggtcctggactctttggtttgtaagctattgattattgccacaatttcagctcctgttattggtcgattaagagattcaacttcttcctggtttagtcttgggagagtgtatgtgtccaggaatttatccatttcttctagattttctagtttatttgcgtagaggtgtttgtagtattccctgatggtcgtttttatttctgtgggattggtggtgatatcccctttatcattttttattgcatctatttgattcttctctctttttttctttattagtcttgctagcggtctatcaattttgttgatcctttcaaaaaaccaactcctggattcattaattttttgaagggttttttgtatctctatttccttcagttctgctctgatttaagttatttcttgccttctgctagcttttgaatgtgtttgctcttgcttctctagttcttttaattgtgatgttagggtgtcagttttggatcttttctgctttctcttgtgggcatttagtgctataaatttccctctacccaccgctttgaatgcgtcccagagattctggtatgttgtgtcttttttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttgttttacatttgctgaggagagctttacttccaagtatgtggtcaattttggaatagctgtggtgtggtgctgcaaaaaaatgtatattctgttgatttggggtggagagttctgtagatgtgtattaggtccgcttggtgcagagctgagttcaattcctgggtatccttgttgactttctgtctcgttgatctgtctaatgttgacagtggggtgttaaagtctcccattattaatgtgtgggaatctaagtctctttgtaggtcactcaggacttgctttatgaaactgggtgctcctgtattgggtgcatatatatttaggatagttagctcttcttgttgaattgatcgctttaccattatgtaatcgccttctttgtctcttttgatctttgttggtttaaagtctgttttatccgagactaggattgcaacccctgcctttttttgttttccattggcttggtagatcttcctccatccttttattttgagcctatgtgtgtctctgcatgtgagatgggtttcctgaatacagcacactgacgggtcttgactctttatccaatttgccagtctgtgtcttttaattggagcatttagtccatttacatttaaagttaatattgttatgtgtgaatttgatcctgtcattttgatgttagctggtgattttgctcgttagttgatgcagtttcttcctagtctcgatggtctttacatattggcatgattttgcagcggctggtaccggttgttcctttccaagtttagtgcttccttcaggagctcttgtaaggcaggcctggtggtgacaaaatgtctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccactgttagtctgatgggcttccctttgagggtaacccgacctttctttctggctgcccttaacattttttccttcatttcaactttggtgaatctgacaattatgtgtcttggagttgctcttctccaggactatctttgtggtgttctctgtatttcctgaatctgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctagacttcccttctcgcttcatttcattcatttcatcttccatcactaataccctttcttccagttgatcgcatcggctcctgaggcttctgcattcttcacgtagttctcgagccttggttttcagctccatcatctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcgttttagagttttcagtttttctgttctgttttttccccatctttttggttttatctacttttggtccttgatgatggtgatgtacagattggtttttggtgtggatgtcctttctgtttgttagttttccttctaacagacaggaccctcagctgcaggtctgttggaataccctgccatgtgaggtgtcagtgtgcccctgcttgggggtgcctcccatttaggctgctcgggggtcaggggtcagggacccacttgaggaggcagtctggccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcctggctgctttgtttacctaatcaagcctgtgcaatggcgggcgcccctcccccagcctcgctgccgccttgcagtttgatctcagactgctgtgctaggaatcagcgagactccgtgggcgtaggaccctccaagccaggtgcgggatataatctcgtggtgcgccgttttttaagccggtccgaaaagcgcaatattcgggtgggagtgacccgattttccaggtgcatccgtcacccctttctttgactccgaaagggaactccctgaccccttgcgcttcccaagtgagggaatgcctcgccctgcttcggctcacgcatggtgcacgcacccactgacctgcgcccactgtctggcattccctagtgagatgaacccggtacctcagatggaaatgcagaaatcacccgtcttctgcgtcgctcacgctgggagctgtagaccggagctgttcctatttggccatcttggctcctcccccgacaattt

SEQ ID NO: 12598 - DNA, 6070 bp, Homo sapiens
ttttgctgtattccataggttttgttttgttttttttatttttttatttttttattattatactttaagttttagggtaatgtgcacattgtgcatgttagttacgtatgtatacatgtgccatgctggtgcgcggcacccactaactcgtcatctagcattaggtatatctcccaatgctatccctaccccctccccccaccccacaacagtccccagagtgtgatgttccccttcctgtgtccatgtgatctctttgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaagtctttgctattgtgaataatgccgcaataaacacacgtgtgcatgtgtctttatagcagcatgatttataatcctttgggtatatactcagtaatgggatggctgggtcaaatggtatttctagttctagatccctgaggaatcgccacactgacttccacaatggctgaactagtttacagtcccatcaacagtgtaaaagtgttcctatttctccacatcctccccagcacctgttgtttcctgactttttaatgattgccattctaactggtgtgagatggtatctcattgtggttttgatttgcatttctctgatggccagtgatgatgagcattttttaatgtgttttttggctgcataaaggtcttcttttgagaagtgtctgttcatgtcctttgcccactttttgatggggttgtttgtttttttcttgtaaatttgtttgagttcattgtagattctcgatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttgtagggtttttatggttttagctctaacgtttaagtctttaatccatcttgaattaatttttgtatgaggtgtaaggaagggatccagtttcagctttctacatatggctagccaattatcccagcaccatttattaaatggggaatcctttccccattgctggtttttctcaggtttgtcaaagatcagatagttgtagatatgtggcattaattttgagggctctgttctgttccattgatctatatctctgttttggttccagtaccatgctgttttggttactgtagccttgtagtatagtttgaagtcaggtagtgtgatgcctccagctttgttcttttggcttacgattgacttggcaatgcgggctcttttttggttccatatgaactaaaaatagttttttccaattctgtgaagaaaggcattggtagcttgatggggatggcattgaatctgtaaattaccttgggcagtatggccattttcatgatattgattcttcctacccatgagcatggaatgttcttccatttgtttttatcctcttttatttcattgagcagtggtttgtagttctccttgaagaggtccttcacatcccttgtaagttggattcctaggtattttattctctttaaagcaattgtgaatgggatttcactcatgatttggctctctgtttgtctgttgttggtgtataagaatgcttgtgatttttgtacattgattttgtatcctgagattttgctgaagttgcttatctgcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccttgtcttgtgccagttttcaaagtgaatacttccagtttttgcccattcagtatgatattggctgtgggtttgtcatagatagctcttattattttgaaatacgtcccatcaatacctaatttattgagagttttgagcatgaagggttgttgaattttgtcaaaggtcttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttggcagtattttattgaggatttttgcatcaatgttcatcaaggatattgattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaggtattgattattgccacaatttcatatcctgttattggtctattcagagattcaacttcttcctggtttagtcttgggagagtgtatgtgtcgaggaatttatccatttcttcttgattttctagtttatttgcgtagaggtgtttgtagtattctctgatggtagtttgtatttccgtgggatcggtggtgatatcccctttatcatttttttattgtgtctatttgattcttctctctttttttctttattagtcttgctagtggtctatctattttgttgatcctttcaaaaaaccagctcctggattcattaattttttgaagggtttttgtgtctctatttccttcagttctgctctgattttagttatctcttgccttctgctagcttttgaatgtgtttgctcttgcttttctagttcttttaactgtgatgttaggatgtcaattttggatgtttcctgctttctcttgtgggcatttagtgctataaatttccctctacacactgctttgaatgcgtcccagagattctggtatgttgtgtgtttgttcttgttcatttcaaagaacatctttatttctgccttcatttcattatgtacccagtagtcattcagaagcaggttgttcagtttccatgtagttgtgcggttttgagtgagattcttaattctgagttctaatttgattgcactgtggtctgagagatagtttgttataatttctgttcctttacatttgctgaggagagctttactgccaactatgtgatcaattttggaataggtgtggtgtggtgctgaaaaaaatgtatattctgttgatttggggtggagagttctgtagatgtctattaggtccgcttggggcagagctgagttcaattcctgggtatccttgttgactttctgtcttgttgatctgtctaatcttgacagtggggtgttaaagtctcccattattaatgtgtgggagtctaagtctctttgtaggtcactcaggacttgctttatggatctgggtgctcctgtattgggtgcatatatatttaggatagttaactcttcttgttgaattgatccctttaccattctgtaatggtcttctttgtctcttttgatctttattagtttaaagtcggttttatcagagactaggattgcaatccctgcctttttttgttttccatttgcttggtagatcttcctccatccttttatttttagcctgtgtgtgtctctgcacgtgagatgggtttcctgaatacagcacactgatgggtcttgactctttatccaatttgccagtctgtgtcttctaattggagcatttagtccatttacatttaaagttaatattgttatgtgtgaatttgatcctgtcattatgatgttaggtggttattttgttcattagttgatgcagtttcttcctagtcttgatggtctttacattttggcatgattttgcagcagcttgtaccggttgttcctttccatgtttagcgcttccttcaggagctcttttagggcaggcctgttggtgacaaaatctttcagcatttgcttgtctgtaaggtattttatttctccttcacttatgaagcttagtttggctggatatttaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttgatttctttttattcttttttctctaaacttcccttctcacttcatttcattcatttcatcttccatcaatgataccctttcttccagttgatcgcatcagctcctgaggcttctgcattcttcacgtagttcttgagccttggttgtcagctccatcactcctttaagcacttctctgtgttggttattctagttatacattcttctaaatttttttccaagttttcaacttctttgcctttggtttgaatgtcctcctgtagctcagagtaatttgatcgtctgaagccttcttctctcagctcgtcaaagtcgttctctgtccagctttgttccattgctggtgaggaactgcgttcctttggaggaggagaggcgctctgctttttagagtttccagtttttctgttctgttttttccccatctttgtggttttatctattttggtctttgatgatggtgatgtacagatgagtttttgatgtggatgtcctttctgtttgttagttttccttctaacagacaggaccctcagctgcaggtctgttggagtaccctgccgtgtgaggtgtcagtgtgcccctgctggggggtgcctcccagttaggctgctcgggagtcaggggtcagggacccgcttgaggaggcagtctgcccgttctcagatctccagctgcgtactgggagaaccactgctctcttcaaagctgtcagacagggacatttaagtctgcagaggttacagctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctgcctcagcctcactgccgccttgcagtttgatctcagactgcggtgctagcaatcagctagactctgtgggcgtaggaccctccgaagcaggtgtgggatataatctcatggtgtgccgttttttaagtccgttggaaaagcgcagtattcgggtgggagtgacccgattttccaggtgccgtccgtcacccctttctttgactaggaaagggaactccctgaccccttgcacttcccgagtgaggcaatgcctcaccccgcttcagctggcacacggtgtgcgcacccactgacctgcacccactgtctggcactccctagtgagacgaacccggtacctcagatggaaatgcagaaatcacccatcttctgcgtcactcaggctgggagctgtagaccggagctcttcctatttggccatcttggctcctccc

SEQ ID NO: 12599 - DNA, 6045 bp, Homo sapiens
gtattaattaaaatttttttttaatattattatactttaagttttagggtacatgtgcacattgtgcaggttagttacatgtgtatacgtgtgccatgctggtgtgctgcacccactaactcctcatctagcattaggtatatctcccaatgctatccctccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaagtacatgaactcatcattttttatggccgcataatattccatggtgtatatgtgccacattttcttaatccagtctatccttgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtattttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcgaaaattttctcccattttgtaggttgcccgttcactctgatggtagtttcttttgctgtgcagaagctctttagtttaattagatcccatttgtcaatttttgtcttttgttgccattgcttttggtgttttagacatgaagtccttgcccatgcctatgtcctgaatggtaatgcctaggttttcttctagggtttttatagttttaggtctaacgtttaagtctttaatccatcttgaattgatttttgtataaggtgtaaggaagggatccagtttcagctttctacatatggctagccagttttcccagcaccatttattaaatagggaatcctttctctattgcttgtttttgtcaggtttgtcaaagatcagatagttgtagatatgtggcgttatttctgagggctctgttctgttccattgatctatatctctgttttggtaccagtaccatgctgttttggttacggtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttatttgtatcctcttttatttccttgagcagtggattgtagttctccttgaagaggtccttcacatcccttgtaagttggattcctaggtattttattctctttgaagcaattgtgaatgggagttcactcataatttgtctctctgtttgtctgttgttggtgtataagaatgcttgtgatttttgtacattgattttgtatcctgagactttgctgaagttgctgctcagcttaaggagattttgggctgagacaatggggttttctagatatacaatcatgtcatctgcaaacagggacaatttgacttcctcttttcctaattgaataccctttatttccttcttctgcctaattgccctggccagaacttccaacactatgttgaataggagtggtgatagaggacatccctgtcttgtgccagttttcaaagggaatgcctccagtttttgcccattcagtatgatattgcctgtgggtttgtcatagatagctcttatgattttgaaatacgtcccaacagtacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcttcaaggatattggtctaaaattctctttttttgttgtgtctctgcctggctttggtatcagaatgatgctggcctcataaaatgagttagggaggattctctcttttcctattgattggaatagtttcagaaggaatggtaccagttcctccttgtacctctggtagaattcggctgtgaatccatctggtcctggactctttttggttggtaagctattgattattgccacaatttcagatcctgttattggtctactcagagattcaacttcttcctggtttagtcttgggagagtgtatgtgtcgaggaatttatccatttcttctagattttctagtttatttgcatagaggtgtttgtagtattctctgatggtagtttgtatttctgtgggattggtggtgatatcccctttatcattttttattgtatctatttgattcttctctctttttttctctattagtcttgctagcagtctatctattttgttgatcctttccaaaaaccaggtcctggattcattaattttttgaagggttttttgtgtctctatttccttcagttctgttctgattttagttatttcttgccttctgctagcttttgaatgtgtttgttcttgcttttctagttcttttaattgtgatgttagggtgtcaattttggatctttcctgctttctcttgtgggcatttagtgctataaatttccctctacacgctgctttgaatgcatcccagagattctggtatgttgtgtctttgttctcgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagagatagtttgttataagttatgttcgtttatatttgctgaggagagctttacttccaaatatgtgatcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctggttgatcctctattgggtgcatatatatttaggatagttagctcttcttgttgaattgatccctttaccattatgtaatggccttctttgtctcttttgatctttgttggtttaaagtctgttttattagagactaggattgcaacccctgcctttttttgttttccatttgcttggtagatcttccttcatccttttattttgagcctatgtgtgtctctgcacgtgaggtgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaaggattttatttctccttcacttatgaaacttagtttggctggatatgaaattctgggatgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggaattgctcttctcgaggagtatctttgtggcgttctctgtatttcctgaatctgaacgttgccctgccttgatagattggggaagttctcctggataatatcctgcagagtgttttcccacttagttccattctccccatcactttcaggtacaccaatcagacgtagatttggtcttttcacatagtcccatatttcttggaggctttgctcatttctttttattcttttttctctaaccttcccttctcacttcatttcattcatttcgtcttccattgctgataccctttcttccagttgattgcatcggctcctgagacttctgcattcttcacatagttctcgagccttggttttcagctccatcaactcctttaagcacttctctgtattggttattctagttatacattcttctaaatttttttcaaagttttcaacttctttccctttggtttgaatgtcctcccgtagctcagagtaatttgatcgtctgaagtcttcttctctcatctcctcaaagtcattctccatccagctttgttccgttgctggtgaggagctgcattcctttggaggaggagaggtgctctgctttttagagtttccagtttttctgttctgttttttccccatttttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcaggggtcaggggtcagggacccacttgaggaggcagtctgcccgttctcagatctccagctgcgtgctgggagaactacggctctcttcaaagctgtcagacagggacatttaagtctgcagaggttactgctgtctttttgtctgggccctgcccccagaggtggagcctacagaggcaggcaggcctccttgagctgtggtgggctccacccagttggagcttcctggctgctttgtttacctaatcaagcctgggcaatggcgggcgcccctcccccagcctcgctgccaccttgcagtttgatctcagacagctgtgctagcaatcagcgagactccgtgggcgtaggaccctccaagcgaggtgcgggatataatctcatggtgcactgttttttaagcccgtcggaaaagcgcagtattcgggtgggagtgacccgattttccaggtgctgtccgtcacctctttctttgactaggaaagggaactccctgaccccttgcgcttcccgagtgaggcaatgcctcgccttgctttggccctcgcacggtgcacgcacccactggcctgcgcccactgtctggcactccctagtgagatgagcccggtacctcagatggaaatgcagaaatcacccatcttctgcgtcgctcatgctgggagctgtagatgggagctgttcctattcggccatcttggcttctccccct

SEQ ID NO: 12600 - DNA, 6031 bp, Homo sapiens
ttttcttatttatttatttatttattattattatactttaagttttagggtacatgtgcacaatgtgcaggttagttacatatgtatacacgtgccatgctggtgcgctgcacccaccaactcgtcatctagcattaggtatacctcccaatgctatccctcccccctgccctcaccccacaacagtccccagagtgtgatgttccccttcctgtgtccacgtgttctcattgttcaattcccacctatgagtgagaatatgcggtgtttggttttttgttcttgcgatagtttactgagaatgatgatttccaatttcattcatgtccctacaaaggacatgaactcatcattttttatgactgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctctgggtatataaccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccattttttgatggggttgtttgtttttttcttgtaaatttgtttgagttcattgtagattctggatattagccctttgtcagatgagtaggttgcgaaaattttctcccattttgtaggttgcctattcactctgatggtagtttcttttgctgtgcagaagctctttagtttaattagatcccatttgccaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatacttgtagatatgcggccttatttctgagggctctgttctgttccattgatctatatctctgttttggcaccagtaccatgctgttttggttactgtagccttgtagtatagtttgaagtcaggtaacgtgatgcctccagctttgttcttttggcttaggatagacttgacgatgcgggctcttttttggtcccatatgaactttaaagtagttttttccaattctgtgaagaaagtcattggtagcttgatggggatagcattgaatctgtaaattaccttcggcagtatggccattttcacgatattgattcttcctacccatgagcatggaatgttcttccatttgtttgtatcctcttttatttccttgagcagtggtttgtagttctccttgaagaggtccttcacatcccttataagttggattcctaggtattttattctctttgaagcaattgtgaatgggagttcactcatgatttggctctgtgtttgtctgttgttggtgtataagaatgcttgtgacttttgtacattgattttgtatcctgagactttgctgaagttgcttatcagcttaaggagattttgggctgagacagtggggttttctagatatacaatcatgtcgtctgcaaacaggaacaatttgacttcctcttttcctaattgaataccctttatttccttctcctgactaattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcattgttgaattttgtcaaaggccttttctgcatctattgagataatcatgtggtttttgtctttgattctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccagctttggtatcaggatgatgctggcctcataaaatgagttagggaagattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcagcttcttcctggtttagtcttgggagagtgtatgtgtcaaggaatttatccatttcttctagattttctagtttatttgcatagaggtgtttgtagtattctctgatggtagtttctgtttctgtgggatcggtgatgatatcccctttatcattttttattgtgtctatttgattcttctctcttttttctttattagtcttgctagcggtttatcaattttgttgatcctttcaaaaaaccagctcctggattcattaattttttggagggtttttttgtgtctctatttccttcaattctgctctgattttagttatttcttgccttctgctagcttttgaatgtgtttgctcttgcttttctagttcttttaattgtgattatagggtgtcaattttagatctttcctgctttctcttgtgggcatttagtgctataaatttccctctacacactgctttgaatgcgtcccagagattctagtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgaactgtggtctgagagatagtttgttataatttctgttcttttacatttgctgaggagagctttactttcaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgttgatctgtctaatgttgacagtggggtgttaaagtctcccattattaatgcatgggaatctaagtctctttgtaggtcactcaggacttgctttatgaatctgggtgctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgaaatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcaatggtctttacattttggcatgattttgcagcagctggtactggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttttttaagaatgttgaatattgacccccactctcttctggcttgtagagtttctgccgagagatccgctgttagtctgatgggcttccctttgagggtaacccgacctttctctctggctgttcttaacattttttccttcatttcaactttggtgaatctgacaattacgtgtcttggagttgctcttctcgaggagtatctttgtggcgttctctgtatttcctgaatctgaacgttggcctgccttgctagattagggaagttctcctggataatatcctgcagagtgttttccaacttggttccattctccccgtcactttcaggtacaccaatcagatgtagatttggtcttttcacatagtcccatatttcttggaggctttgctcgtttctttttattcctttttctctaaacttcccttctcgcttcatttcattcatttcatcttccatcgctgataccctttcttctagttgatcgcatcagctcctgaggcttctacattcttcacgtagttctcgagccttggttttcagctccatcagctcctttaagcacttctctgtattggttattctagttattcattcttctaaattcttttcaaagttttcaacttctttgcctttggtttgaatgtcctcccatagttcggagtaatttgatcgtctgaagccttcttctctcagctcgtcaaagtcattctccgtccagctttgttccattcctggtgaggaactgcattcctttggaggaggagaggagctctgctttttagagtttccagtttttctgctctgttttttccccatctttgtggttttatctacttttggtctttgacgatggtgatgtacagatgggttttttgtgtggatgtcctttctgtttgttagttttccttctaacagacaggaccctcagctgcaggtctgttagagtacccggccgtgtgaagtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttcagtctgcagaggttactgctgtctttttgtttgtctgtgccctgcccccagaggtggagcctacagaggcaggcaggcctccttgagctgtggtgggctccacccagttcgagcttcccggctgttttgtttacctcagcaagcctgggcaatggcgggcgcccctcctccagcctcgctgccaccttgcagtttgatctcagactgctgtgctagcaatcagcgagactctgtgggcgtaggaccctctgagccaagtgcgggatataatctcctggtgcgccgttttttaagcccgtcggaaaagcgcagtattcgggtgagagtgacccgattttccaggtgccctctgtcacccctttctttgactaggaaagggaactccctgaccccttgtgcttcctgagtgaggcaatgcctcgccctgcttcggctcacgcacggtgcgcgcacccactgacctgtgcccactgtctggcactccctagtgagatgaacctcagatggaaatgcagaaatcacctgtcttctgcgttgctcacgctgggagctgtagaccggagctgttcctatttggccatcttg

SEQ ID NO: 12601 - DNA, 6031 bp, Homo sapiens; identical to SEQ ID NO: 12600

SEQ ID NO: 12602 - DNA, 5640 bp, Homo sapiens
tttttttctctttttttaattattattatactttaagttttagggtacatgtgcacaatgtgcaggtttgtcacatatgtatacatgtgccgtgctggtgtgctgcacccattaactcatcatttagcattaggtatatctcctaaagctatccctcccccctccccccaccccacaacagtccccagagtgtgatgttccccttcctgtgtccatgtgttctcattgttcagttcccacctatgagtgagaatatgcagtgtttggttttttgttcttgcgatagtttactgagaatgatgatttccagcttcatccatgtccctacaaaggacctgagctcatcattttttatggctgcatactattccatggtgtatatgtgccacattttcttaatccagtctctcattgttggacatttgggttggttccaagtctttgctatggtgaatagtgtcgcaataaacatacgtgtgcatgtgtctttatagcagcatgatttatagtcctttgggtatatacccagtaatgggatggctgggtcaaatggtatttctagttctagatccctgaggaatcgccacactgacttcaacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttgtttggctgcataaatgtcttcttttgagaagtgtctcttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcattcacatcccttgtaagttggattcctaggtattttattctctttgaagcaattgtgaatgggagttcactcatgatttggctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacagtttgacttcttcttttcctaactgaataccctttatttccttctcctgcctaattgccctggccagaacttccaacacaatgttgaataggagtggtgagagagggcatccctgtcttgtgccagttttcaaagggaatgcttccagtttttgcccattcagtatgatattggctgtgggtttgtcatagatagctcttattattttgagatatgtaccatcaatacctaatttattgagagtttttaacatgaagagttgttgaattgtgtcaaaggccttttctgcatctattgagataatcatgtggttattgtctgtggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacgtctggtagaattcggctgtgaatccatctggtcttggactctttttggttcgtaagctattgattattgccacaatttcagatcctgttattggactattcagagattcaacttcttcctggtttagtgttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcgtctatctgattcttctctctttttttctttattagtcttgctagcggtctatcaattttgtggatcttttcaaaaaaccagctcctggattcgttaattttttgaagggttttttgtgtctctatttccttcagttctgctctgattttagttatttcttgccttctgctagcttgtgaatgtgtttgctcttgcttctttagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagttattcaggagcaggttgttcagtttccatgtagttgagcggttttgagtaagattcttaatcctgagttctagtttgattgcactgtggtctgagagacagtttgttataatttctgttgttttacatttgctgaggagagctttacttccaagtatgtgatcaattttggaataggtgtggtgtggtgctgaaaaaaatgtatattctgttgatttggggtggagagttctgtagatgtctattaggtctgcttggtgcagtgctgagttcaattcctgggtttccttgtttactttctgtctcgttgatctgtctgtgttgacagtggggtgttaaagtctcccattattattgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctacctttttttgttttccatttgcttggtagatcttcctccatccttttattttgagcctatgtgtgtctctgcacgtgagatgggtttcctgaatatagcacactgatgtgtcttgactctttatccaatttgccagtctgtgtcttttaattgaagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtatcggttgtttctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttatagagtttctgccgagagatcagctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctcaatgttggcctgccttgctagattggggaagttctcctggataatatcctgcagaatgttttccaacttggttccattctccccgtcactttcaggtacaccaatcagacgtagatttggtcttttcacatagtcccatatttcttggaggctttgctcatttctttttattcttttttctctaaccttcctttctcgcttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgcctgaagccttcttctctcagctcgtcaaagtcattctccatccagctttgttccgttgctggtgaggaactgcattcctttggaggagaggcgctctgctttttagagtttccagtttttctgttctgttttttccccatctttgtggttttatctacttttggtctttgatgatgttgatgatgatgatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacccttaagtctgcagaggttattgctgtctttttgtttgtctgtgccctgcccccaaaggtggagcctacataggcaggcaggcctccttgagctgtggtggggtgcacccagttcgtgctttccagctgctttgtttacctaagctagcctgggcaatggaaagcgcccctcccccagcactaaatacaacctttcagtttgctctc

SEQ ID NO: 12603 - DNA, 6203 bp, Homo sapiens
ttttcttttcttgcatgtaaatctctttattttattttattttattattattatactttaagttttagggtacttgtgcacaatgtgcaggttagttacacatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattattcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccaaattttcttaatccagtctataattgttggacatttgggttggttccaagtctttgctattgtgaatagtgccgcaataaacatgcgtgtgcatgtgtctttatagcagcatgatttatagtccattgggtatatacccagtaatgggatggctgggtcaaatggtatttctagttctagatccctgaggaaccgccacactgacttccaaaagggttgaactagtttacagtcccaccaacagtgtaaaagtgttcctatttctccacatcctctccagcacctgttgtttcccgactttttaatgatcgccattctaactggtgtgagatggtatctcattgtggttttgatttgcatttctctgatggccagtgatggtgagcattttttcatgtgttttttggctgcataaatgtcttcttttgcaaagtgtctgttcatgtcctttgcccactttttgatggggttgtttgtttttttcctgtaaatttgtttgagttcattgtagattctggatattagccgtttgtcagatgagtaggttgagacaattttctcccattttgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggcaaagcctaggttttcttctagggtttttatggttttaggtctaacatttaagtctttaatccatctcgaattaatttttgtataagatgtaaggaagggatccagtttcagctttctacatatgactagccagttttcccagcaccatttattaaatagggaatcctttccccattgcttgtttttctcaggtttgtcaaagatcagatagttgtcgatatgtggccttatttctgagggctgtgttctgttccattgatctatatctctgttttggtaccagtaccatgctgttttggttactgtagccttgtagtatagtttgaagtcaggtagcgtgatgcctccagctttgttcttttggcttaggattgactaggcgatgtgggctcttttttggttccacatgaactttaaaggagttttttccaattctgtgaagaaagtcattggtagcttgatggggatggcattgaatctataaattaccttgggcagtatggccattttcacggtattgattcttcctatccatgagcatggaatgttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaattttgtcaaaggccttttctgcatctgctgagataatcaggtggtttttgtctttggttctgtttatatgctggattacatttattgatttgcatatattgaaccagccttgcatcccagggatgaagcccacttgatcatgctggataagctttttgatgtgctgctggattcagtttgccagtattttattgaggatttttgcatcaatgttcatcaaggatattggtctaaaattctctttttttgttgtgtctctgcccagctttggtatcaggatgatgctggcctcataaaatgagttagggaggattccctctttttctattgattggaatagtttcagaaggaagggtaacagttcctccttgtacctctggtagaatttggctgtgaatccatctggtcctggactctttttggttggtaaactattgattattgccacaatttcagagcctgttattggtttattcagagattcaatttcttcctggtttagtcttgggagggtgtatgtgtcaaggaatttatacatttcttctagattttctagtttatttgcgtagaggtgtttgtagtattctctgatggtagtttgtatttctgtgggattggtggtgatatcccctttatcattttttattgcacctatttgattcttctctcttttcttctttattagttttgctagcagtctatcaattttgttgatcctttcaaaaaaccagctcctggattcattaattttttgaagggttttttgtgtctctatttccttcagttctgctctgattttagttatttcctgccttctgctagcttttgaatgtgttttctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctccttggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaagaaaatgtatattctgttgatttggggtggagagttctgtagatatctattaggtctgcttggggcagagctgagttcaattcctgggtatccttgttaactttctgtctcattgatctgtctaatgttgacagtggagtgttaaagtctcccattattattgtgtgggagtgtaagtctctttgtaggtcactcaggacttgctttatgaatctgggtgctcctgtattgggtgcatatatatttaggatagttagctcttcttgttgaattgatccctttatcattatgtaatggccttctttgtctcttttgatctttgtttgtttaaagtctgttttatcagagattaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacctttaaagttaatattgttatgtgtgaatttgatcctgtcattatgatgttagctggtgattttgctcgttagttgatgcagtttcttcctagccttgatggtctttacaatttggcatgattttgcggtggctggtaccggttgttcctttccatgtttagtgcttccttcaggagctcttttagggcaggcctggtggtgacaaaatctctcagcatttgcttgtctgaaaagtattttatttctccttcacttatgaagcttagtttgactggatatgaaattctgggttgaaaattattttctttaagaatgttggatattggcccccactctcttctggcttgtagaatttctgctgagagatccgctgttagtctgatgggcttccctttgtgggtaacctgacctttctctctggctgcccttaacattttttccttcacttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtccctttcaggtacaccaatcagccgtagatttggtcttttcacatagtcccatatttcttggaggctttgttcatttctttttattcttttttctctaagcttcccttctcgcttcatttcattcatttcatcttccatcactgataccctttcttccagttgatcgcatcagctcctgaggcttctgcattcttcacgtagttctcgagtcttggctttcagctccattagctcctttaagcacttctctgtattggttattccagttatacattcgtctaaatttttttcaaagttttcaacttctttgcctttggtttgaatttcctcctgtagctcggagtactttgatcctctgaagccttcttctctcagctcgtcaaagtcattctccgtccagttttgttccgttgctggtgaggagctgtgttcctttggaggaggagaggcgctctggtttttagagtttccagtttttctactctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcggtggctgcagaacagcggattttcatgaaccacgaatgctgctgtctgatcattcctctggaagttttgtctcagaggagtacccagccgtgtgaggtgtcagtctgcccctactggggggtgcctcccagttaggctgcttgggggtcaggggtcagggacccacttgaggagggaggcagtctgcccattctcagatctccagctgcgtggtgagagaaccactgctctcttcaaagctgtcagacagggacatttaagtctgcagaggttactgttgtctttttgtttgtctgtgccctgccctcagaggtggagcctacagaggcaggcaggccttcttgagctgtggtgggctccacccagttggagcttcctggctgctttgtttacctaagcaagcctgggcaatggcaggtgcccctcccccagcctcgctgccgccttgcagtttgatctcagactgctgtgctagcaatcagcaagactccttgggcgtaggaccctctgagccaggtgcgggatataatctcgtggtgtgccgttctttaagcccattggaaaagcacagtattcgggtgggagtgacccgattttccaggtgctgtctgtcacccctttctttgactaggaaagggaactccctgaccccttgcgcttcccgagtgaggcaatgcctcaccctgcttcagctcatgcatggtgcgctgcacccactgtcctgcgccctctgtctggcactccctagtgagatgaacccggaacctcagatggaaatgcagaaatcacccgtcttctgcgtcgctcacgctgggagctgtagaccggagctgttcctatttggccatcttggctccagcccct

SEQ ID NO: 12604 - DNA, 6177 bp, Homo sapiens
tttcagattttttttattattattatactttaagttttagggtacatgtgcacaatgtgcaggttagttacatatatatacatgtgccatgctggtgtgctgcacccattaactcgtcatttagcattaggtatatctcctaatgctatccctccccccttcccccaccccacaacagtccccagagtgtgatgttccccttcctgtgtccatgtgttctcattgttcaattcccatctatgagtgagaatatgcggtgtttggttttttgttcttgcgatagtttactgagaatgatgatttccaatttcacccatgtccctacaaaggacatgaactcatcattttttatggctgcatagtattccatggtgtatatgtgccacattttcttaatccagtctatcattgatggacatttgggttggttccaagtctttgctattgtgaatagtaccgcaataaacatatgtgtacatgtgtctttatagcagcatgattggtagtcctttgggtatatacccagtaatgggatggctgggtcaaatggtatttctagttctagatccctgaggaatcgccacactgacttccacaatggttgaactagtttacagttccaccaacagtgtaaaagtgttgctatttctccacatcctctccagcacctgttgtttcctgactttttgatgattgccattctaactggtgtgagatgatatctcattgtggttttgatttgcatttctctgatggccagtgatggtgagcattttttcatgtgttttttggctgcataaatgtcttcttttgagaagtgtctgttcatatcctttgcccactttttgatggggttgtttgtttttttcttgtaaatttgtttgagttcattgtagattctggatattaaccctttgtcagatgagtaggttgcgaaaattttctcccattttgtaggttgccgattcattctgatgatagtttcttttgctgtgcagaagctctttcatttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatctggaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttaaagtcgttttttccaattctgtgaagaaagtcattggtagcttgatggggatggcatcgaatgtgtaaaataccttgggcagtatggccattttcacgatattgattcttcctacccatgagcatggaatgttcttccatttctttgtatcctcttttatttccttgagcagtggtttgtagttctccttgaagaggtccttcatgtcccttgtaggttggattcctaggtattttattctctttgaagcaattgtgaatgggagttcactcatgatttggctctctgtttgtttgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgccctttcagtatgatattggctatgggtttgtcatagatggctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatatcgaaccagccttgcatcccagggatgaagctctcttgatcatggtggataagctttttgatgtgctgctggatttggtttgccagtattttattgaggatttttgcatcaatgttcatcaaggatattggtctaaaattctcttctttggttgtgtctctgcccggctttggtatcaggatgatgctggcctcataaaatgagttagggaggattccctctttttctattgattggaatagtttcagaaggaagcataccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtccaggaatttatccatttcttctagattttccagtttatttgcgtagaggtgtttgtagtattctctgatggtagtttgtatttctgtgggattggtggtgacatccccgttatcattttttattgtgtctatttgattcttctctcttttcttctttattagtcttgctagtggtctatcaattttgttgatcctttcaaaaaaccagctcctggatgcattaattttttgaagggttttttgtgtctctatttccttcagttctgctctgattttagttatttcttgccttctgctagcttttgaatgtgtttgctcttgcttttctagttctttcaactgtgatgttagggtgtcaattttggatctttcctgctttctcttgtgggcatttagtgctataaatttccctctacacactgctttgaatgtgtcccagagattctggtatgttgtgtctttgttcttgttggtttcaaagaatatctttatttctgccttcatttcgttatgtacccagtagtcattcaggagcaggttgttcagtttccatgtagttgagcggttttgagtgagtttcttaatcctgagttccagtttgattgcactgtggtctgacagacagtttgttataatttctgttctcttatatttgctgaggagagcttcacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggaatctaagtctctttgtaggtcactcaggacttgctttatgaatctggatgctcctgtattgggtgcatatatatttcggatagttagctcttcttgttgaattgatccctttaccattatgtaatggccttctttgtctcttttgatctttgttggtttaaagtctgttttatcagagactaagattgcaacccctgcctttttttgttttccatttgcttggtggatcttcctctatccttttattttgagcctatgtgtgtctctgcacctgagatgggtttcctgaatacagcacactgatgggtcttgactctttatccaatttgccagtctgtgtcttttgattggagcatttagtccatttacatttaaagttaatattgttatgtgtgaatttgatcctggcattatgatgttagctggttattttgctcgttagttgatgcagtttcttcctagctttgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggcaggatatgaaattctgggctgaaaattcttttctttaagaatgttgaatattggcccccactctcttctggcttgtagattttctgctgagagatctgctattagtctgatgggcctccctttgtgggtaacccgacctttctctctggctgcccttaacattttttccttcatttcaactttggtgaatctgacaattatgtttcttggagttgctcttctcgaggagtatctttgtggtgttctccgtatttcctgaatctgaatgttggcctgccttgctagattggggaagttctcctggataatatactgcacagtgttttccaacttggttccattctccccgtcactttcaggtacaccagtcagacttagatttggtcttttcacatagtcccatatttcttggaggctttgtttgtttctttttattcttttttctctcaacttcccttctcgcttcatttcattcatttgatcttccatcactgataccctttcttccagttgatcgcattggctcctgaggcttctgcattcttcacgtagttctcgagccttggctttcagctccatcagcgcctttaagcacttctctgtagtggttattctagttatacattcgtctaaatttttttcaaagtttttaacttcttcgcctttggtttgaatttcctcctgtagctcggagtagtttgatcgtctgaagccttcttctctcaactcatcaaagtcattctccatccagctttgttccgttgctggtgaggaactgcgttcctttggaggaggagaggcattctgctttttagagtttccagtttttctgctctgtttcttccccatctttgtgtttttatctacttttggtctttgatgatggtgatgtacagatgggtttttggtgtggatgtcctttctgcttgttagttttccttctaacagacaggaccctcagctgcaggtctgttggagtttgctagaggtcccctccagaccctgtttgcctgggtatcagcagcggtggctgcagaacagcggattttcatgaacctcgaatgctgctgtgtgatcgttcttctggaatttttgtctcagaggagtacccagccgtgtgaggtgtcagtctgcccctactggggggtgcttcccggttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctctttgtctgtgccctgcccccagaggtggagcctacagaggcaggcaggcctccttgagctgtggtgggctccacccatttcgagcttcccggctgctttgtttacctaagcaagcctgggcaatggtgggcgcccctccctcagccttgctgccaccttgcagtttgatctcagactgctgtgctagcaatcagggggactccgtgggcataggaccctccaagccaggtgcgggatataatctcctggtgcgccgttttttaagcccgtcggaaaagtgcagtattagggtgggagtgacccgattttccaggtgctgtctgtcacccctttctttgactaggaaagggaactccccgaccccttgcgcttcccgagtgaggcaatgcctcgccctgcttcgtcttgcgcacggtgcgctgcacccactgtcctgcacccactgtctggtactccctagtgagatgaacctggtacctcagatggaaatgcagaaatcacccgtcttctgcgtcgctcatgctgggagctgtaaaccagagctgttcctattcggccatcttggctggcaatcccagatatttgt

SEQ ID NO: 12605 - DNA, 6193 bp, Homo sapiens
tttttttttattatttttattttattttattttatttattttattattattatactttaagttttagggtacatgtgcacattgtgcaggttagttacatatgtatacatgtctcatgctggtgtgctgcaaccattaactcgtcatttagcattaggtaaatctcctaatgctatccctcgccccttcccccaccccacaacagtccccagagtgtgatgttccccttcctgtctctatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttattaatccagtctatcattgttggacatttgggttggttccaagtctttgctattgtgaatagtgccgcaataaacatatgtgtgcatgtgtctttatagcagcatgatttatagtcctttgggtatgtacccagtaatgggatggctgggtcaaatggtatttctagttctagatccctgaggaatcgccacactgacttccacaatggttgaactagtttacagtcccaccaacagtgtaaaagtgttctgatttctccacatcctctccatcacctgttgtttcctgactttttaatgattgccattctaactggtgtgagatggtatctcatcgtggttttgatttgcatttctctgatggccagtgatgatgagcattttttcatgtgttttttggctgcataaatgtcttcttttgagaagtgtctgttcatgtcctttgcccactttttgatggggttctttgtttttttcttgtaaatttgtttgagttcattgtagattctggatatcagccctttgtcagatgagtaggttgcgaaaattttctcccattctgtaggttgcctgttcactctgatggtagtttcttttgctgtgcagaagatctttagtttaattagatccaatttgtcaattttgtcttttgttgccattgcttttagtgttttagacatgaagtccttgcctatgcctatgtcctgaatggtaatgcctaggttttcttctagggtttttatggttttaggtctaatgtttaagtctttaatccatcttgaattaatttttgtataaggtgtcaggaagggatccagtttcagctttctacatatggctagccacttttcccagcaccatttattaaatagggaatctttctccattgcttgtttttctcaggtttgtcaaagatcagatagatgtagatatgtggcattatttctgagggctctgttctgttccattgatctatatctctgttttggtaccagtaccatgctgttttggttactgtagcctagtagtatagtttgaagtcaggtagcatgatgcctccagctttcttcttttggcttaggattgacttggcgatgcgggctcttttttggttccatatgaactttaaagtagttttttccaattctgtgaagaaagtcattggtagcttgatggggatggcattgaatctataaattaccttgggcaatatggccattttcaagatattgattcttcctacctatgagcatggaatgttcttccatttgtttgtatcctcttttatttcattgagcagtggtttgtagttctccttaaagaggtccttcacatcccttgcaagttggattcctaggtattttattctctttgaagcaattgtgaatgggagtttactcatgatttggctctctgtttgtctgttattggtgtataagaatgcttgtgatttttgtacattgattttgtatcctgagactttgctgaagttgtttataagcttaaggagattttgggctgagacaatggggttttctagatatgcaatcatgtcatctgcaaacagggacaatttgactttctcttttcctaattgaataccctttatttccttctactgcctacttgccctggccagaacttccaacactatattgaataggagtggtgagagaggtcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatacactggattacatttattgatttgcatatattgcaccagccttgcatcccagggatgaagcccacttgatcatggtggataagctttttgatgtgctgctggattcagtttgccagtattttattgaggatttttgcatcaatgttcatcgaggatattggtctaaaattctcttttttggttgtgtctctgcccggctttggtatcaggatgatgctggtatcataaaaggagttagggaggattccctctttttctattgtttggaatagtttcagaaggaatggtaccagttcctccttgtacctgtggtagaattcggctgtgaatccatctagtcctggactctttttgattggtaagctattgattattgccacaatttcagagcctgttattggtctattcagagattcaacctcttcccgttttagtcttaggagggtgtatgtgtcgaggaatttatccatttcttctagattttctaatttatttgcgtagaggtgtttgtagtattctctgatggtagtttgtatttctgtgggatcagtggtgatatcccctttatcattttttattgcatctatttgattcttctctcttttcttctttattagtcttgctagcagtctatcaattttgttgatcctttcaaaaaaccagctcctggattcattaattttttgaagggttttttgtgtctctatctccttcagttctgctctgattttagttatttcttgccttctgctagctgttgaatgtgtttgctcttgttgcttttctagttcttttaattgtgatgttagggtgctaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgtaaccagtagtcattcaggagcaggttgttcagtttccatgtagttgagcggttttgagtgagtttcttaatcctgagttctagtttgattacactgtggtctgagagacggtttgttataatttctgttgttttacatttgctgaggagagctttacttccaagtatgtggtcaattttggaataggtgtggtgtggtgctgaaaaaaatgtatattctcttgatttggggtggagagttctgtagatgtctactaggtctgcttggtgcagagctgagttcaattcctgggtatccttgttgactttctgtctcgttgatctgtctaatgttgacagtgaggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgactttgttggtttaaagtctgttttatcagagactgggattgcaacccctgcctttttttgttttccatttgcttggtagatcttcctccatccttttattttgagcctgtgtgcgtctctgcacatgagatgggtttcctgaatacagcacactgatgggtcttgactctttatccaattttccagtctgtgtcttttagttggagaatttagtccatttacatttaaagttaatattgttatgtgtgaatttgatcctgtcattatgatgttagctggttattttgcccgttagttgatgcagtttctccctagtcttgatggtgtttacattttggcatgattttgcagtggctggtaccggttgttcctttccatgtttagtgcttccttcaggagctcttgtagggcaggcctggtggtgacaaaatctctcagcatttgcttgtctgtaaagtattttatttctccttcgcttatgaagcttagtttggctggatatgaaattctgggttgaaaattcttttctttaagaatgttgaaaattggcccccactgtcttctggcttgtagagtttcttccgagagatccgctgttagtctggtgggcttccctttgtggataacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctgggtaatatcctgcagagtgtttttcaacttggttccattcttcccatcactttcaggtacactaatcagacgtagatttggtcttttcacatagtccatatttcttggagactttgttcatttccttttattcttttttctctaaacttcccttctcacttcatttcattcatttcatcttccatcactgataccctttcttccaattgatcgcatttgctcctgaggcttctgcattcttcacgtagttctcgagccttggctttcagctccatcagctcctttaagcacgtctttgtattggttattctagttatacattcgtctaaatttttttcaaagtttttaacttctttgcctttggtttgaatttcctcctgtagctcggtgtagtttgatcgtctgaagccttcttctctcaactcgtcaaagtcattctccgtccagctttgttccgttgctggtgagagactgcgttcctttggagaaggagaggcactctgctttttagagtttccagtttttctgctctgttttttccccatctttgtggttttttctacttttggtctttgatgatggtgatgtacagatgggtttttggtgtggatgtcctttctgtttgttagttttccttctaacagacaggaccctcagctgcaggtctgttggagtttgctagaggtccactccagacgctgtttgcctgggtatcagcagcagtggctgcagaagagtggatttttgtgaaccgcgaatgctgctgtctgatcgttcctctggaagttttgtcttagaggagtacccggccatgtgaggtgtcagtctgcccctactggggggtgcctcccagttaggctgctcaggagtcaggggtcagggacccacttgaggaggcagtctgctcgttctcagatctccagctgcatgctgggagaaccactgctctcttcaaagctgtcagacagggacatttaagtctgcagaggttactgctgtctttttgtttgtctgtgtcctgcccccagaggtggagcctacagaggccgacaggcctccttgagctatggtgggctccacccagttcgagcttccaggctgctttgtttaccgaagcaagcctgggcaatggcgggcgcccctcccccagcctcgctgctgccttgcagtttgatctcagactgctctgctagcaatcagtgagactccgtgggcgtaggaccctccgagccaggtgcgggatataatctcctggcacgccgctttttaagcctgttggaaaatcgcagtattagcgtgggagtgacctgactttccaggtgctgtctgtcaccccttcctttgactaggaaagggaactccctgaccccttgtgctccccaactaaggcaatgcctcaccctactttggctcgcgcacggtgcgctgcacccactgtcctgcgcccactatctggcagtccctagtgagatgaacccggtacctcagatggaaatgcagaaatcacccatcttctgcgtcgctcgtgctaggagctgtagaccagagctgttcctattcagccaccttggctgccc

SEQ ID NO: 12606 - DNA, 6044 bp, Homo sapiens
ttttctttttcttttttttttttaattaactttaagttttagggtacatgtgcacattgtgcaggttagttacatatgtatacatgtgccatgctggtgcgctgcacccactaactcgtcatctagcattaggtatatctcccgatgctatccctcccccctccccccaccccaccacagtccccagagtgtgatattccccttcctgtgtccatgtgatctcattgtgcaattcccacctatgagtgagaatatgcggtgtttggttttttgttcttgcgatagtttactgagaatgatgatttccaacttcaaccacgtccctacaaaggacatgaactcatcattttttatggctgcatactattccatggtgtatatgtgccacattttcttcatccagtctatcattgttggacatttgggttggttccaagtctttgctattgtgaattgtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgacttgcatttctctgatggtcagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctcatggtagtttcttttgctgtgcagaagctctttagtttatttagatcccatttgtcaattttgtcttttgttgccactgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgcctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttgtcttaggattgacttggcgatgcgggctcttttttggtttcatatgaactttaaagtagtttcttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatgtgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcaagaagagttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattccttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctgttgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtccaggaatttatccatttcttctagattttctagtttatttgtgtagaggtgtttgtagtattctctgatggtagtttgtatttctgtgggatcagtggtgatatcccctttatcattttttattgcatctattggattcttctctctttttttctttactagtcttgctagtggtctatcaattttgttgatcctttcaaaaaaccagctcctggattcattaattttttgaaggggttttgtctctctatttccttcagttctgctctgaaattagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcattggtttcaaagaagatctttatttctgccttcatttcgttatgtacccagtagtcattcaggagcaggttgttcagtttccatgtatttgagtggttttgagtgagattcttaatcctgagttctagtttgattgcactgtggtctgagagatagtttgttataatttctgttcttttacatttgctgaggaaagctttacttccaagtgtgtggtcaattttggaataggtgtggtgtggtgctgaaaaaaatgtatatcctattgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtaggagtctaagtctctttgtaggtcactcaggacttgctttatgaatctgggtgctcctgtattgggtgcatatatatttaggatagtcagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctccatggtctttacattttggcatgattttgcagcggctggtaccggttgttcctttccatgttcaatgcttccttcaggagctcttctaaggcaggccttgtggtgacaaaatctctcagcatttgcttgtctgtaaaggattttatttctccttcacttatgaagcttagtttggctggatatgagattctgggttgaaaattcttttctttaagaatgttgaatattggcccccactgtcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctcttatttcctgaatctgaatgttgccctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctgtttattcttttttctctaaacttcccttcttgcttcatttcactcatttcatcttccattgctgataccctttcttccagttgattgcatcggctcctgaggcttctgcattcttcatgtaattctcgagctttggttttcagctccatcagctcctttaagcacttctctgtactggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccgttgctggtgagggactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagaaaggaccctcagctgcaggtgtgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgctcccagaggtggagcctacagaggcaggcaggcctccttgagctgtggtgggctccacccagttcgagcttccaggctgctttgtttacctaatcaagcctgggcaatggcgggcgcccctcccccagcctcgctgccgccttgcagtttgatctcagactgctgtgctagcaatcagcgagactctgtgggcgtaggaccctctgagccagatgcgggatataatctcgtggtgcgccgttttttaagcccatcggaaaagcgcagtatttgggtgggagtgacccgattttccaggtgccatccatcacccctttctttgactcagaaagggaactccctgaccccttgcgcttcccaagtgaggcaatgccttgccctgcttcggctcgcgcacggtgcacgcacccactgacctgcgcccactgtctggcactctctagtgagatgaacccggtacctcagatggaaatgcagaaatcacccgtcttctgcgtcgctcacactgggagctgtagaccggagctgttcctattcggctatcttggctcctcccccata

SEQ ID NO: 12607 - DNA, 10789 bp, Homo sapiens
ttttttttactttatttttttatttttttattttttttttattattattattttttattatactctaagttttagggtacacgtgcacattgtgcaggttagttacatatgtatacatgtgccatgctggtgcgctgcacccactaatgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttggattggttccaagtctttgctattgtgaatagtgccgctataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtagggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcctagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagagttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttctgtacccagtagtcattcaggagcaggttgttcagtttccatgtagttgagcggctttgagtgagatttttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttatcattatgtaatggccttctttgtctcttttgatctttgttggtttaaagtctgttttatcagagactaggattgcaacctctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctgatacgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttatttgcctttggtttgaatgtcctcccgtagctcagagtaatttgatcgtctgaagccttcttctctcagctcgtcaaaatcattctccatccagctttgttccgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcagaaagggaactccctgaccccttgcgcttcccaggtgaggcagtgcctcgccctgcttcggctcgcgcacggtgcgcacacacactggcctgcgcccaccgtctggcactccctagtgagatgaacccggtacctcagatggaaatgcagaaatcacccgtcttctgcgtcgctcatgctgggagctgtagaccggagctgttcctattcggccatcttggctcctcctcctccaatttttccataagtattttgaagctattattccgttgccttatgattctaatgttgctattgagaattccattatgagtctaatttagtgatcctcaatcaaggacaatattgccctccaaggacatctggcaatgtctggagacatttttggttgtcacaactggggggaagatgctactagcatctaatagttagaatctaggaaaaatgctaaatatcctacaatgtacagaacagtcctccacaactaagaagtatctggtccacaatgtcagtagtgctgaaattgagaaactctggtcaaattcttgttgctgtataagtaatatgttttctctttggttactttttaaaaacttgtctttgttgttttagtgttttgctatgagatgactatggtgtatttattgtcattcatcttgtttgggactcattgtacttcttacatctgagaatttatatctttcacctattttagaatattctcagtcattttcactgcaaatattttctgtttctcactttctcttttatatctttatggatgtcttactagatatatgttgggccttttcattctatttttcatgttaattaatctgtcacacttttcatctctttcaaaacctattacatttggataatttcctcatatatttcttccagttcactgatttttcttctaatatctgtagcctgtttttgaatatgtccattgtttttaatttttatgttccacatttttatttccagaatttctatttatttttcaaacattttttcatagtcacttttaatagaattttgagtctttcttttgtccttatttcaacatacttatttcatactattttttatattttagagctttttttctattatctcacttattggtgctctacccttgcagttttttctgtctgccaacccatttgtgatggaaaatatgtttgtgtgtgttataaattcagattgtgcccttatagtaaacagggcttgttttatctatggtaaccccttattttctgagtatgtagattttttttctaccaggtgtttcgggagtatcaccagccaagaacctaattttacattaatttatcaatttgaagattttccatacaaagtgaatggtgtaaattctaaactccaatccacatgaggtacagactccactattgctattttaactccgaagctatattttctatcctctcgacttcccttctttgtctaatccaaggtcaaccatagcatccattcacaagtttacttttctgtttgtaatttcctcttcatttctggcacatggaaatttcctttcttgtcagctcagctatgcatttaaaataatttgtgttgtaattcgtcaagtattatagagggagggttttcagactgttgtagagcagaacaagaagtcagcactcatcttatctctctttacttattttctatttcttttccccaaggagttgattggcatagatctacatgccctgtgtcttgttccagtcaaggatggcatcgctctgttcaagtcatggcctttgtaaaatatgacctgtcttaccgtcttcttccacttctcaagatgctgctggccttattagtgtattaaagtttatttccttctccagtccctcttaactgtctcctcccttggggctgcctagcacagaccattgccctgcacacaatgtaagcctcctgggccttatataagccacatgcttaccatgtgtacatacacacatttttgcatctgtctcaccgagttttcctcctatactggtgttgtgcttttcattggcctttccttgaattataagggcaagatccactcttaagcttaggacaaaaatgcagagactttaagagacttaagtgatataatgaatgccagggaaagaaagaagcaagaagtctcatttctgtgtcctaccctaaacttggccttccaaattcaacttttatcaaaacatttatcttttttaaaccttttatcaaaaccctcaaacgtagggggttttcagttgtttgctcaaatacgtaagtggtcatttgtttctcattttccttttcatgctcatgtttatactccttggtgagaaacgcagagggaagaaagggttattgccaccctaaaatcctaattaaatttttccttttgattcttctcagatataaacttctaaatgcaattattagatatgttcagacaaaaatctttatgattgaaaacataattattgatgctgatttatgcttcctgttgttcttattaaattgcagccgtttaaatatctagtaggctgctcttttaaggcttttttgctaagacagaagagctaataatgcatttgggagctctgtcataaagctctccaggcacatgctcattagtaagcttctacccagtgtgtcaatcaaatcattgcaaattgcatctgaaaattattctgcccattttcaaaggattttttgttacgattccagaaaaatgcaaatttgttccagccagtttatcctaagatgtgttcttctaaagcatcactgtgatattgataggctattattccaagctaagttcagatcttcatacaaagaactgagcctatctaaagcaacgaaatgcagcaggccctaactgggggctgtactcaactattgggaatgtctgagtattcattttgagaccacttccatccatagcatgatgtgtgaacttaggtaaggtggctgcatatagctctgctgatacactgttatttttttcctgatttctctgtctcttatagatttcataaatattgtcagttaggatgaaggaatttcaacctctctataatagctgatgctttataaaactaaaagagatctcaggagaaatatttgataactaatgaattaatctttgctaatgggtgggtcaaataatttgtattagtgacactgcaatacagtttgcccaggacacccagaaagtatgatctaaccttcttcactttcaaaacagagagacagagagcagtgttatggaaaaggtgtaggtgttggaaactgatcaaccaaattctgatcccaattctgctgcttacagctgtgtgacttcaggcaagtttctaagcctgtctgaaccaccattcactttatttccttacaatgaagaaatcattacatctaagcaggattaaactaggtactcaattattttatttcccttacccttcattagtagcaaaatgacaggctaatcaggtattagagattttttcaaaactccatcaattttctgttcagtaagagatcagtgatgaaaataagcatgactcaaatataattattctaatactgtatatcctaatcttttgttctatctcattgacagaacacttgagagtaattttagatttttgtaagtcatcaatccatcattatatgtgggccaacatctgtgcataacgactgggaattactaagaaaaatttattcatactgattgaatagcagagccatatgcagaagacaccttttattttattttattttattattatactttaagttttagggtacatgtgcacattgtgcaggttagttacatatgtatacatgtgccatgctggtgcactgcacccactaactcgtcatctagcattaggtatatctcccaaagctatccctcccccctccccccaccccacaacagtccccagagtgtgatgctccccttcctgtgtccatgtgatctcattgttcaattcccacctataagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggattgctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactgccgtgagatggtatctcattgtggttttgatttgcattcctctgatggccagtgatgatgagcatttcttcatgtgttttttggctgcataaatgtcttcttttgagaagtgtctgttcatgtcctttgcccactttttgatggggtttgttttttcttgtaaatttgtttaagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtttaacgtttaagtctttaatccatcttgaattga

SEQ ID NO: 12608 - DNA, 9322 bp, Homo sapiens
tttttttttttcaagagaattaaatcgtttattgattatgcatgataatggaaggtacacaaacttcattcccatctataattttattgggtaccattattcaatttagatatattgcataggatatgccaacaatcgttttaataaccaataattccatgattttgctttgctaatcccttttaatggtgaacttcaggtcacaacagtaactatcagttcaaccacaccaaggtttctgaagacaatggtttctccacccaagcaggttgtatataaattccaaaaagaacctggcatcaccctgaaggaactctaacttcacactgtaggggaaatttaccaagatggcttcagagtagaacaactttacacagcacattaaaaaaaaaaaagacatttattcagcgtcccaatcaggctattatatttagcaatcaacagcataggtgaaaaaaaaatctacattaaaaccctttgttggcatggtttacactttccacagaacagaaactaaaataacctgttacacaattagtcacaaatacagtcctcgagttttttgcccacacacatgagtatttgtctaaaacatgtctgctttgtagcagctgggccctgccaccactgtgcttggctgagttcacaaatctgttgtaacctgtagcttccctgtcacttctctggctctcctctcctgctaagctttgtttcctaattaaaatcttctgccactgccatagctactgctgctactggaaccaccatagccaccttggttttgtggtttggcaaagtattggcctccaccaccacaggggacagagcttctgcctccaaagtttcctcccttcaggggtccaaaatttggagactgattgttgtaattgtcaaaatcactgtagcttccgccacctccaaaattgcttccatcattaccaaatccactgtagtcatccccagccaccatattcaccaccaccacagctgccaccaaagccaccacgaccatggaagtttcctccatgacccaagttgtcattcccgctgaaaccacctccatgaccaccaccaaagtttccagaaccactcttgctttgacagggctttcctagcttcacagctgtggccattcaagtatgctatttctgaatgacagtcttatccatggagtcaccgttgtcaaacgttacaaaggcaaagccccttttcttgccaatgcctcggtcagtcatgatttcaatcacttcaattttttccatactgttcaaaatgatcccttaggtgatgttcttcagtgtcttctttaatgccaccaacaaatatatttttcacagttaactgggcacctggtctttgagaattttctcttgagacaactctctttgcttctacaactcttttttttttttttttttttttttttttttttgagatggagtcttgctctgtcgcccaggctggagtgcagtggtgccatctcagctcactgcaagctccgcctctcgggttcatgccattctcctgcctcagcctcctgtgtggctgggactacaggcgcctgccaccacatctggctaagtttttgtatttttagtagagacgggtttcaccgtgttagccaggatggtctcgatctcctgacctcgtgatccgcctgccttagccccccaaagtgctgggattataggcgtgaggttctacaactcttccatctaccttgtgtggccttgcattcatggctgcatccacctcctccacagtggcacacatgacaaacccacaggccctggagcgcttggtgtttggatctctcattaccacacagtccgtgagcgttccccattgctcaaaatggctcctcaggctctcattggttgtttcaaagctcaaccctccaatgaagagcttccttagctgtttgggctctttaggagactcttgacttagacatgactgacagggagaagagagactttaaccatgcttccttggtggcctccacgggcaggtaggtttgttttgttttgttttgttttgttttgttttggtaaatagttttcccaccattttattataagcattatcaaatatactgaataattgaaataatcagaaacaacaaatttgcatatatccaccatctttttttttttttttgagacagagtttccctctgttgcacaggctggagagcaatggggaatggggggatctcagctcactgcaacctctgtctcttgggttcaaccaattctcatgctttagcctcccacgtagctgagattatgtgcactgtgcaccaccacatccggctaatttttgtatttttagtagagatggggtttcaccatgttggccaggctgatcttgaactcctagcctcatgtcatctgcccaccttggcctctcaaagtgctgggatcacaggcgtgagctaccacattcagccactaccatctagattctacaattagcaattaatttgctttattatacatttattcaaccatctatttgttgatacctctgtccatccattaatccatctttttttttgaggcatttcaaggtaagttgtagatatcaacatacttcattcaatacttcagcatgcatatcatttagagtcatgtatatgagtttttcttggtaagattttacatatagtagatgcacaatctgtattttatttatttatttatttttggagacagacctctgtcacccaggctggagtgcagtggtgctatcatggctcactgaagcctcaacttcccaggctgaagtaatcttcccacctcagcctcccgagtagctgtgtctctaggtgcatgccactaggcctagctaattcttaaaatttttttgtagagacagggtctcacaattttgcccaggctggtctcaaactcctggcctcaagttatcctctcaccttagcctcccaagtagcttaaattactggcataagccaccatgcccagctttgatgcacaatcttaagtataccattcagtgaattttgacaaatgcagacacttatataatccaaactcctatcaagatagagaatatttatatcttcccagaaagttcactcacattccttcccagaaaatccccacatatccatccctcaaaaggcaaccactactctcacatttttcaacatgtcttaatatagtacagtgtgtaagagtttcagtgttccatcacctcactgacattggtgttgccaatcttttcattttagacattctgatatatttatagtaatatatctttgactaatgattttgagcatttatttatgtattcataccattctcatatctttcttcgtgaaatattggtctaaatattttgcccattttaaactgggttgtcttattttcttttctctatttttgagttgggatattattttgtcgcccaggctggagtgcagtggcaccatcatagctccctgcagctcaacctcctgggctcatgctatcctcccaccctagccttccagtttctgagattacaggtgtgagcaactgcaccctgatgcctctttattattgagctgtatttttactttggataatagtcctttctcaaatatatatatttgcacctttttctcagcctgtggcttaccgattcactttcttagcactgtcttttggtgcagaatattggctcaaccagttatgcaaatctttcaagtattgacacatttcattatacaaaattaaaatgacattcttttttaaattttattattattctttaagttttagggtacatatgcacaacgtgcaggtttgttacatatgtatacatgtgccatgttggcgtgctgcacccattaactcgtcatttagcattaggtatatctcctaatgctacccctccccactccccctaccccacaacaggccccggtgtgtgatgttccctttcctgtgtccatgtgttctcattgttcaattcccatctatgagtgagaacatgtggtgtttcttttttgtccttgcgatagtttgctgagagtgatggtttccagcttcatccatgtccctacaaaggacatgaactcatcgttttttatggctgcatagtattccatggtgtatatgtgccacattttcttaatccagtctatcatcattggacatttggcttggttccaagtctttgctattgtgaatactgccacaataaacatacgtgtgcatgtgtctttatagcagcatgatttataatcctttgggtatatacccagtattgggatggctgggtcaaatggtatttctagttctagatccctgaggaatcgccacactgacttccacaatggttgaactagtttacagtcccaccagcagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtctgttggctgcataaatgtcttctttcgagaagtgtctgttcatatccttcacccactttttgatggggttgtttttttcttgtaaatttgtttgagttcattgtagattctggatattagccctttgtcagatgagtaggttgcaaaaatgttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtattgcctaggttttcttctagggtttttctggttttaggtctaacctgtaagtctttaatccatcttgaattaatttttgtataaggtgtaaggaagggatccagtttcagctttctacatatggctagccagttttcccagcaccatttattaaataggaaatcctttccccattgcttgtttttctcaggtttgtcaaagatcagatagttgtagatacgtggcattatttctgagggctctgttctgttccattggtctatatctctcttttggtaccagtaccatggtgttttggttactgtagccttgtagtatagtttgaagtcaggtagcgtgatgcctccagctttgttcttttggcttaggattgacttggcaatgtgggctcttttttggttccatatgaactttaaagtagttttttccaatactgtgaagaaagtcaatggtagcttgatggggatggcattgaatctataaatgaccttgggcagtatggccattttcacgatattgattcttcctacccatgagcatggaatgttcttccatttgtttgtatcctcttttatttcattgagcagtggtttatacttctccttgaagaagtccttcacatcccttgtaagtttgattcctaggtattttattctctttgaagcaattgtgaatgggagttcactcatgatttggctctctgtttgtctgttactggtgtataagaatgcttgtgattttttacattgatttttgtatcctgagactttgctgaagttgcttatcagcttaaggagattttgggctgagacgatggggttttccagatatgcaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttactattttaagatacgtcctatcaatacctaatttattgagagtttttagcatgaagggctgttgaattttgtcaaaggccttttctgcctctattgagataatcatgtggtttttgtctttggttctgtttacatgctggtttatgtttactgattttcgtgtgttgaaccagccttgcatcccaggcatgaagtccacttgatcatggtggataagctttttgaggtgctgctggatttggtttgccagtattttattgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacttctggtagaattcaggtgtgaatccatctggtcctggactttttttggttggtaggctattaattattgcctcaatttcagagcctgttattggtctattcagagattcaacttcttcctggtttagtcttgggtgggtgtatgtgtcgaggaatttatccatttcttctagattttctagtttatttgtgtagaggtgtttatagtattctctgatggtagtttgtatttctgtggaatcggtggtgatatcccctttgtcattttttattgcatctgtttgattcttctctcttttcttctttattagtcttgctagaggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgttagggtgtcagttttagatctttcctgctttctcttctgggcatttagtgctataaatttccctctacactctgctttgaatgtgtcccagagattctggtatgttgtgtctttgttcttgttggtttcaaagaacatctttatttctgccttcatttcgttatgtacccagtagtcattcaggagcaggttgttcagtttccatgtagttgtgcggttttgagtgagtttcttaatcctgagctctagtttgattgcactgtggtctgagagacagtttgttataatttctgttcttttacatttgctgaggagtgctttccttgcaactatgtggtcaattttggaataggtgtggtgtggtgctgaaaagaatgtatattctgttgatttggggtggagagttctgtagatgtctattaggtccgcgtggtgcagagctgagttcaattcctggatatccttgttaactttctgtctcgttgatctgtctaatgttgatggtggggtgttaaagtctcccattattattgtgtgggagtctaagtctctttgaaggtcactcaggacttgctttatgaatctgggtgctcctgtattgggtgcatttatatttaggacagttagctcttcttgtggaattgatccctttaccattatgtaatggccttctttgtttcttttgatctttgttggtttaaagtctgttttatcagagactaggattgcaacccctgcctttttttgttttccatttgcttggtagatcttcctccatccttttattttgagcctatatgtgtctctgcacgtgagatgggtttgctgaattcagcacactgatgtgtcttgactctttatccaatttaccattctgtgtcttttaattggagcgtttagcccatttacatttaaggttaatattattatgtgtgaatttgatcctgtcattatgatgttagctggttattttgctgattagttgaggcagtttcttcctagcctcgatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatattaaattctgggttgaaaattctttcctttaagaatgttgaatattggcccccactctcttctggcttgtagagtttctgccgagagatcagctattagtctgatgggcttccctttgtgggtacccgacctttctctctggctgcccttaacatttttttcctttatttcaactttggtgaatctgacaattatgtgtcttggagttgctcttctcaaggactatctttgtggcattctgtgtatttcctgaatttgaatgttggcctgccttgctggagtggggaagttctcctggataatattctgcagagtgttttccagcttggttccattctccctgtcactttcaggtacaccaatgagacgttgatttggtcttttcacatggtcccatatttcttggaggctttgttcgtttctttttattctttttttcaaaacttctcttcttgcttcatttcattcatttcgtcttccatcgctgattccctttcttccagttgatcgcatcagctactgaggcttgtgcattcgtcacgtagttctaatgccatggttttcagctccatcaggtcctttaaggacttctctgcattggttattctagttagccgttcatctaattttttttcaaggttcttaacttctttgccatgggttcgaacttcctcctttagctcggagtagtttgatcttcttaagccttctctcaactcatcaaagtcattctctgtccagctttgttccgttgctggtgaggagctgcattgctttggaggaggagaggtgctctgatttttagagtttcccgtttttctgctttgttttttccccatctttgtggttttatctacctttggtctttgataatggtgacgtacagatgggtttttggtgtggatgtcctttctgtttgttagttttccctctaacagtcaggaccctcagctgcaggtctgttggagtttgctggaggtccactccagaccctgtttgcctgggtatcagcagcggtggctgcagaacagcggatattggtgaaccgcaaatgctactgcctgatcattcctctggaagttttgtctcagaggagtacccggccatgtgaggtgtcagtccgcccctactggggggtgcctcccagttagggtactccggggtcagggacccacttgaggaagcagtcttcccattctcagatctcaagctgcgtgctggaagaaccactactctcttcaaagctgtcagacagggacatttaagtctgcagaggttactgctg

SEQ ID NO: 12609 - DNA, 6072 bp, Homo sapiens
ttttttcttttctctaaccagtgcttttctgactctttttttttttttttttatactctaagttttagggtacatgtgcacattgtgcaggttagttacatatgtatacatgtgccatgctggtgcgctgcacccactaatgtgtcatctagcattaggtatatctcccaatgctattcctcccccctcccccgaccccaccacagtccccagagtgtgatattccccctcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacactgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagcccttggtcagatgagtaggttgcgaaaattttctcccgtgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccatcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgctcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagctttaggagattttgggctgagacgatggggttttctagataaacaatcatgtcgtctgcaaacagggacaatttgacttcctcttttcctaattgaatcccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggcagaattcggctgtgaatccatctggtcctggactctttttggttggtaaactattgattattgccacaatttcagagcctgttattggtctattcagagattcaacttcttcttggtttagtcttgggagagtgtatgtgttgaggaatgtatccatttcttctagattttctagtttatttgcgtagaggtgtttgtagtattctctgatggtcgtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatccgagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacacttttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttctagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtgtctttgtggcgttctctgtatttcctgaatctgaacgttggcctgccttgctagattggggaagttctcctggataatatcctgcagagtgttttccaacttggttccattctccatatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgaggtgtcagtgtgcccctgctgggcggtgcctcccagttagctgctcgggggtcaggggtcagggacccacttgaggaggcagtctgcctgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcacccactgtctggcactccctagtgagatgaacccggtacctcagatggaaatgcagaaatcacccgtcttctgcgtcgctcacgctgggagctgtagaccggagctgttcctattcggccatcttggctcctcctcccttt

SEQ ID NO: 12610 - DNA, 7091 bp, Homo sapiens
tatttttttttgttattatactttaagttctagggaacatgtgcacaacgtgcaggtttattatgtatacatgtgccatgttggtgtgctgcacttgttaactcgtcatttacattgggtatatctcctaatgctatccctccaccttcagcccaccctacgacaggccccggtgtgtgatgttccccaccctgtgtccaagtgttctcattgttcaattcccacctataaatgagaatatgcagtgtttggttttctgtccttgcgatagtttgctcagaatgatggtttccagcttcatccatgtccctacaaaggacatgaactgatccttttttatggctgcatagtattccatggtgtatatgtgccacattttcttaattaggtctatcattgatggacatttgggttggttccaagtctttgctattgtgaatagtgctgcaataaacatacatgtgcatgtgtctttatagcagcatgatttataatcctttgggtatatgtccagtaatgggatggctgggtcaaatggtatttctagttctagatccttgaggaatcgccacactgtcttccacaatggttgaactagtttacagtcccaccaacagtgtaaaagtgctcctatttcttccacagcctctacagcatctgttgtttcctgactttttaatgttcaccattctaactgctgtgagatggtatctcattgtggttttgatttgcatttctctgatggccagtgatgatgagcattttttcatgtgtctattggctgcataaatgtcttcttttgagaagtgtctgttcatatactttgcccactttttgatggggttgtttgattttttcttgtaaatttgtttaagttctttgtagattctggatattagccctttgtcagatgagtaggttgcaaaaattttctcccattctgtaggttgcctgttcactctgatggtagtttcttttgctatgcagaagttctttggtataattagatcccatctgtcaattttggcttttgttgccattgcttttggggttttggtcatgaagtccttgcccatgcctatgtcctgaatggtattgcctaggttttcttctacagtttttatggttttaggtctaacatttaagtctttaatccatcttgaattaatttttgtataaggtgtaaggaagggatccagttgcagctttctacatatggccagccagtttccccagcaccatttattaaataggcaatccttttcccatttcttgtttttgtcaggtttgtcaaagatcaggtggctgtagctgtgtggtgttatttctgaggtctctgttctgttccattggcctatatctctgttttggtaccagtaccatgctgttttgcttactatagccttgtagtatagtttgaagtctggtagcgtgatgcctccagctttgttctttggcttaggattgtggcaatgcaggctcttttttggttccatatgaactttaaagtagttttttccaattctttgaagaaagtcattggtaacttgataaggatggcattgaatctataaattacctttggcagtatggccattttcatgatattaattcttcctatccatgagcatggaatgttcttccatttgtttgtgtcctcttttatttcattgagcagtggtttgtagttctccttgaagaggtccttcacatcccttgtaagttggattcctaggtattttattttctttgaagcaattgtgaatgggagttcgctcatgatttggctctcttgtttgtctgttattgatgtataggaatgcttgttatttttgcacattgattttgtatcctgagactttgctgaagttgcttatcagcttaaggagattttgggctgagacgatggggttttctaaatatcatgtcatctgcaaatagggacaatttgacttcctcttttcctaattgaataccctttatttctttctcctgcctgattgccctggccagaacttctaacaccatgttgaataggagtggtgagggagggcatccctgtcttgtgccagttttgttttcaaagggaatgcttccagtttttgcccactcagtatgatattggctgtcagtttgtcataaatagctcttattattttgagatacgtcccatcaatacctagtttattgaaagtttttagcatgaagggctgttgaattttgtcaaaggccttttctgcatctgttgagataatcgtgtggtttttgtctttggttctgtttatatgatggattaaatttatggatttgcatatgttgaaccagccttgcaacccagggatgaagccaactggatcatggtggataagctttctgatgtgctgctggattcgatttgccagtattttattgaggatttttgcatcgatgttcatcagcgatattggtctaaaattctctttttttgttatgtctctgcccggctttggtatcaggatgatgttggcctcacaaaatgaattagggaggattccctctttttctattgattggaatagtttcagaagaaatggtgccagctcctctttgtacctctggtagaattcggctgtgaatccatctggtcctggactttttttggttggtaggctattaattattgcctcaatttcacaacctgttattggtctaatcagggattcaacttcatcctggtttagtcttaggaggttgtatgtgtccaggaatttatccatttcttctacattttctagtttatttgcgtagaggtgtttatagtattctctgatggtagtttgtatttctgtgggatcagtggtgatatcgcctttatcattttttattgcatctatttgattcttctctcttttcttctttattagtcttgctagcagtctatcaattttgttgatctctcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgtttgggtgtcagttttagatctttcctgctttctcttgtgggtatttagtgctataaatttccctctacacactgctttgaatgtgtcccagagattctggtatgttgtgtctttgttctcattggtttcaaagaacatctttatttctgccttcagaaataaatgactactgtacccagtagtcattcaggagcgggttgttcagtttccatgtagttgagcagttttgagtgagtttcttaatcctgagttctagtttgattgcactgtggtctgagagacagtttgttttaatttctgttctttaaaatttgctgaggagtgctttacttccaactatgtggtcagttttggaatacatgtgatgtggtgctgagaagaatgtgtagtctgtagatttgggatggagagttctgtagatgtctattaggtccacttggtgcagagctgagttcaattcctggatatccttgttaacgttctgtctcgttgatctgtctaatgttgacagtggggtgttaaagtctcccattattgttgtgtgggagtgtaagtctctttgtaggtctctaaggacttgctttatgaatctgggtgctcccgtattgggtgcgtatatatttaggatagttagctcttcttgttgaattgatccctttaccattatgtaatggccttctttgtgtcttttgatctttgttggtttaaagtctgttatatcagagactaggattgcaacccttgcttttttctgttttccatttgcttggtagatcttccaccatccctttattttgagcctatgtgtgtctctgcacatgagatgggtctcctgaatacagcacactgatgggtcttgactccttatcccatttgccagtctgtgtcttttaattggagcatttagcccatttacattaaggttaatattgttatgtgtgaatttgatcctgtcattatgatgttagctggttattttgctcattagttgatgcagtttcttcctagcatcaatggtctttacaatttggcatgtttttgcagtggcttttaccagttgttcctttccatgttcactgcttccttcaggagctcttgtaaggcaggcctggtggtgacaagatttctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtcttatgggcttccctttgggggtaacctgacctttctctctggccgcccttaacattttttccttcatttcaactttggtgaatctgacaattatgtgtcttggagttgctcttcttgaggagtatctttgtggtgttctctgtattttgtgaatttgaatgttggcctcccttgctaggttgaggaagttctcctggataatatcctgaagagtattttccatcttggttccattctccccatcactttcaggtacagcaatcagacatagatttggtcttttcacatagtcccatatttctcagaggctttgtttgtttctttttactcttttttctctaaacttatcttctcacttcatttcatttatttgatcttcaatcactgatgccctttcttctacttgatgaaatcagcttctgaagcttgtgcatgcgtcaggtagttcttgtgccatggttttcagctccatcaggtcatttaaggacttctctacactgtttattctagttagccattcgtccaatcttttttcaaggtttttagcttctttgcaatgggttcaaatatcctcctttagctcagagaagtttgttattaccaatcttctgaagccttcttctctcaactcatcagagtcaatctccgtccagctttgttccgttcctggtgagcggctgcattcctttggaggggaagaggggctgtgatgtttagaattttcagcttttctgctctggtttctccccatctttgtggttttatatacctttggtctttgatgatggtgacgtacagatggggttttggtgtggatgtgctttctgtttgttagttttccttctaacagtcaggaccctcagctgcaggtctgttggaatttgctgctggtccactccagaccctgtttgcctgggtatcaccagtggaggctgcaggactgcaaatattgcagaacagcagatgttgctgtctgatccttcctctggaagcttcgtctcagaggggcactggactgtatgaggtgtcagtcagcccctactgggaggtgtctcctagttaggctactcgggggccagggacccacttgaggaggcagtctgtcagttctcagatctcagacttggtgctgggagaaccactactctcttcaaagctgttagacagggacgtttaagtctgcagaagtttcttctgccttttgttcagctatgtcctgcccccagaggtggagtctactgaggcaggcaggcctccttgagctgcggtgggctccacccagttggagcttcctggcctctttgtttacctactcaggcctcagcaatagcggacacccctcccccagcctcgctgctgccttgcaatttgatctcagactgctgtgctagcagtgattgaggctctgtgggcgagtgacccttacagccaggtgtgggatataatctcctgctgtgccatttgctaagaccgttggaaaagtgcagtattagggtgggagtgtcccgattttccagatacagtctgtcatgacttcccttaggtaggaaagggaattcctggacccttgggcttcccgggtgaggcagtgccccaccctgctttgtgggctgcactcactgtctgacaagccccagtgagatgaacctggtacctcagttggaaatgcagaaatcacctgtcttcggcgttggtcacgctaggagctgcagactggagctgttcctatttggctgtcttggaacctctctagatcatgtatttttatgcattctggcaatctgtgtcttttgattagagagtttactccatttacatttaaagtaattactgataaggaggaatttaaatctgtcattttgctgcatgttttttatatgccatgcatcttatttaccttttgtttcctacattattgtcttcttttgtgtttaatttttatagtgaaatatttaaattcctttgtcattttcttttgtgtacattctacagatattttctttaaggttgccatggggattacatttggtatttaaagttgtaacactctaggctgggcgcagtggttcacgcctgtaatcctagcactttcggaggccgaggtgggtggattgcaaggtcaggagattgagaccatcctggctaacatggtgaaaccccgtctctactaaaaataccaaaacaaaattagccgggcgtggtggtgggcacctgtagtcccagctactcaggatgctgaggcgagagaatggcgtgaacctgggaggcggagcttgcagtgagccgagatcatgccactgtactccagcttgggcaacagagcgagactccatctcaaaaaacaaacaaaaaaacaaaacaaaaagttataacactctaatttgaatttataccatcttaacttcagtaacacacaaaatctttgctcctttatagctctgccctcacctcttttgattgttattttcacaagattacattattatacattgtgagtccaaaaatgtaaatgaatactttctttaaatgtattcatttacattttgtatttaaatgaatttatgtatttaaatgaatttatgtatttaaatgaatatatgtatttaaatgaatatatgtatttaaatgaatatttctttaaatgtaaattttcatttgaactttggtgaatctgacaattatgtgtcttggagttgctcttctcaagg

SEQ ID NO: 12611 - DNA, 27812 bp, Homo sapiens
gagcaaagtccaagagatgaattatattcagaaaactctgttcaagatagggtatgattacaaattggaacagatcaaaaagggatatgatgcacctctttgcaatctgtaagtacatttcataggctctgtggtttgagcctttaaatttttttatgcttttaaatccagaagatgaataaataaatggcaagttaattcatttgaatatcaccaccatgatcataaggttgaaattctcttttattctaagtcttattgtttatacagcaagcagaggactctgatcttggcaatttaacaaattttaataattgagtgtatatttaagatttatttataaaatttagtttcatgaagaaaaactaaaatagacttttgaatcaagacacttgagcttaaaaaatgtcatttctaactaaaaaaagtgacctccattgcatgaaggtttctgatttattgtattcataaaatagtgtagtaagtatatgaatataacttattttaaatgtgatgctgaggagtggggatggggaagcattttttattggaagtgagataagataggtgattaaatgttccaaagataattaaaatttttttacctctgatgtctgttttctttcatttacttgtgtcagcatagtttcccgatgctacacattatctttcttcatttttaaagagttttttctggcatttttacaaggcgttactagttgttgccttgttaacctctcattctcaccgtgattctgacattgagatgttcaaccagttgaggaatctttcccagagcttataaattagtgtgttgccaagaataatgtatgcgtacattaaaatcatttatcctccctttattaaggttactgtttaaaaaggtcaaggccctgctgggagggaatgtccgcatgatgctgtctggaggggccccgctatctcctcagacacaccgattcatgaatgtctgcttctgctgcccaattggccagggttatggactgacagaatcatgtggtgctgggacagttactgaaggtaagcattattaatgtggtaaatattctgtatcagctgctactaataaaatacattcgcattacctttggaaaccatggtaactttaaaatacctcttaactaatatcagattcattgcaaatcagtgtagttttggtttatgaattcttaattataagtatcatgtggaccctttcattttaagccttataattttttttttttttgagatggagtttcactcttgttgcccaggctggagtgcaatagcataatctcagctcactgcaacctccacctcctgggttcaaacaattctcctgcctcagcctcccaagtagctgggattacaggcgtgtgccaccatgcccagctaatttttgtatttttagatggggtttcaccatgttgaccaggctggtctcgaactcctgacctcaggtgatctgcctgcctcggcctcccaaagtgctgggattacaggcggtgagccaccacgcccggtcgccttataaatatttatgccacacagtcggtcctcaaaatcctgtcaccctggtcctttagtcttctttctctaaatgatcacttctttggagaactgtactattaaaaatgaagtatcacttttatgctccctcttaaatctgtgttcctgtcctaacttcttctttggtttcccttttgttattttcaacagcctgaagcgaggtttcccaaccctgacactgttcaaattttgaatccgataattctttgttgttgagggctgttgtatgcattgcagaatatttagttgccaaagcagatgtttatgggctcaccccagctgtgacaatgaaacatatccccaaacattgccagatatcccctggggggcaaaatcactttaggttgagaaacactggggtataggaattgtttttttggataatcttattttcgctttaaactcattgtgtccaaaatcaatgccattattctaaactgtctctctattgacaaattatttgtttgtgtcaatggtgataccatccttaaagtcattccaggtatcagctttgaagtcatctgtttattttaaaatatctttaaatgtcatcagatcattccttcattaggtttctcctttccctccatatcacctctgtcgtccaactttttattgctccattctgctccgacctaacagcctttttatttttgagacagagtcttgctctgttgcccaggctggagtgcagtggcacaatctcagctcactgcaacctccgcctcccgggttcaagcaattctcttcccttagcctcctgagtagctgggactacaggcgtgtgccaccacacctgactaatttttgtatttttagtagaagcggggttttaccatgttggccaggctggtctcgaactcctgacctcaggtgatccacccacctcagcttcccagagtattaggattacaggcgggagccactgcgcctgccctgacctaacagccttgtaacagctgtgtctgcctacattacatcacttctgatttatcctgtatccttctattagatgcatccacctcatccactgcttgatacctgatgtatcaaatctaaacacctctttacctagctttgacatctttaatctgatgctagtgtacttatccaacatcattttccattattccccacatatacacaatgcctggctcttctctccagacccaccagtcttcttactgtttcttatgaaggcattcttggtctcacctctatgtattttcttttcccttctcttggaatgtcctttttgcttattgatcacaaccatcttttaatgcccacttttcaataatgtctttcctaactacttcattttacattcattgtttaagtctctaagctactattgtgcttaccttcagtgcccatgcagtttagtatttaaatgttctctgaattgtttcacatgcatttcttcccagttcatttgtaaggtcattgagtgcagggtctccttatctctcatgtgctgtttacataatgggctgtccataaatatttgtttattgctagcaataatcacaaattgcaaatggatatcatcatcatgatgatgtttgacaacagcagctaacatcttttgaaggcttagcttgtgccaagaagtgttaagcattgtccatgtatcatctcatttaatcctcacagcatatccctgtatgaagtaggttttgttactatctccatttcatagatgaggaaatggaggcttagagaggctaagttacttgtccatgttacatagccaatgagtggtagagcaggaattccaatcaaaatctatcttatgacaagcttaggtagataacggtggagccatctctcctcctttaacagatattttgtacttaattacataaaatataaccatgaaaagcaaaaatgatgtaacaacaatggaatccattgcactattgaagtggagttgaaatactgaaaaatgatcacactttgcactccttcttttgtcatttttctgactctggttctaactctaatattcccagtgcattggtacaaatctggaatgtggtatgctaatatctctgttactttttccctcacagtaactgactatactactggcagagttggagcacctcttatttgctgtgaaattaagctaaaagactggcaagaaggtaagaattttatgaaaagctctagtgattcaagatatgctgaaaactactgtcagctttatgactttcatttctttaaagtctggggaagcaaataattctctgctgttttgctgttgcctgtccccatgcattctttttcctcagtgatatctttaggttcccaagaggaaaataaaatctctagaatctaggattaatgattctgaacttgacaatacttgaaggtaaagagaaaaaaaattcttactggagctttctgggtttggagaaggtgaggatccttgaaacttgactttactagtgagaatgtttgggctgagaaaccccagatttttaggggatagaatgatgggttgcactcatacacacaccaacttcttagatcttgatcccagaaaagattttcatagttgagactcaactgtccagctatttgtatagttgaatttttatatgtacctgcacagacaagccacttagaagaaaactagagacattgatgatcatcctttctataaattagctgaaggcaaatatcaaccagtcttcttaatgaaagatactaaatatacacagtaactacaataaagtagattgttaaataaaacaaataattaacagcctagccatgtcagataaaggaagagtaattaaaatgcttaagattttaaaagagaatatttaccttaggatggaacacggactaaaaatttaaagtacaagttaccgtgtaggatgcaacccttaggttgtccaaaccctgagaaaatgaatacgtttttatctaacataaactttaagtttctaaagcattttttattatgtgtgttattgtcagtgctttatgagcaaatgactatttcttttttaaaaacacattttaaaaagccagttgcattcccaagagttttacaccttgggacttagtcttccctttttccatggtaatggcattccaattttaccatgaaaatctgaagaaaatagtttgtgtgtatgtgttttggacatcaacatcagaattattttattaggtaagtttttaattgttaggcagtggaatcagagaaatgtttaaaggcaaaaatctccttaccaagttttactataatttttattttctgatttcctggtactgggccttaatgtcagttttggggagtaggtcccttgttgaacatgtatttggagttttccttgctgtgaagactctttggctttatactgtatgaatgatctcagtttttttttaacatacaatgggttttatcatgttgaaatattgaatagttttaagtttatcagagcagctaacagctgaaaggaaccctgattttaatccttttatgacacaaaatctagtctatatcttattttgcaaatttagatttttgtatattttccttaaagtaagcttccttcagtaatacagaggtaatgagtagtgatgaaatatattagtatttattatcaattagtttagtgtttgaacttctaaagtcatgactggccacaggcaaaattaatacaattttcttcctgtttcccatagtcccccctttccctctcactttatgatgctaccatttttgggtacttactgcatgttctttttggttaaaacctccttagaaaaaatttgaaatgcattgatatcagtatgtcagtaatttacttataacagcttcaagtgttactcttcctgggggtgattttatcttaacagaactctgtgaacactaagctctaatggtgttctaagtgtgaaatgttatggtatgggaaggtttgagatgggtgattgttggtggtgattatcattgagcctttcttggtgttcttaaaatcacagtcacccagtatcctcatgtaaattttagtaaatataaactaatgttctctcataaagtgatataaaatctgatcagcagaaaaatactaacatacgtataagctttaagaattaatgaaatttgttgtagaacaataactaatttacttttatgatttccaggcggttatacaattaatgacaagccaaaccccagaggtgaaatcgtaattggtggacagaacatctccatgggatattttaaaaatgaagagaaaacagcagaagattattctgtggatgaaaatggacaaaggtggttttgcactggtgatattggagaattccatcccgatggatgtttacagattataggtcagaatgttttctttttatggttttctttagtttttataacttcagtatatatgaaaggtaatattgatcagtcattaataaagttgatggttccattagttcaaactttggacaagttatttaacttatgtatgagcttctccatcagcaaaacaaggacaataccaacctcatagggctgtcgttaagattaaatgagttgatatatgtaaaatattctaaacagagcctgaaccttagcgtaagtactagcagcactagcaacagcagcattgagtgtagagagaatgggcagggaaatagcaaacaggtaatgagaaaacaaaaagagctcagaggacgtctttcttggtcaaccacatgtgattttatataactgtttcctataacatactctatgctaggccttcctcactcttcacctctccacccaaggggcagcatgggcacatatatttttttttactgttggctatttatatgtgtctaacgaggcctgaaccttagaaaattaatatcaatccttagcactagtcagttctgagaatgtcagttactttggcattgtcctcattgagtctactgaagtggacctttatgttcaaaaaatgactccaaaatgggcccttgtgctattcacttggatgaggcaaaagttaaaacttgctgatgagaacccctcagcaagatcccagtcaggtcttttttaagacatagagtttcctcacctatatgtagtgactgatttcaatccatcgctggacctcacgatatctgacctgaatatagttagagatttcctgggaaaattggttcttcatctagaaatttgaaccaggaaccatggttcagttgagaaacaataagcttttttcccccttgttccttaattgcactggaatcaaaggttatttctgtagagtgggttcccaggctacgggtaggcaaatcagcactcatactcattccaaggccatgtgatgattattcaagctgtgccatcctgtgctagcactttcttagagaactgtcattttaacaagataatgtcaaaagtggaaaaggagaattaacatgtgttaaatgtgttctatatgccagacattgtgggatatgtctgtatgaggtaggcatcattatcctgataaaacttgaggattagaaggttaactgacatgccgaggatcacttagctagtaccaggcagagttaccattcagatagaatgttccaaagtcctagttccctctattaaattgattataatatttaagattataataagatgctaaagctttgggtttaaggtgtaacttttagccaatacttacttaagtaggcattttatttttaactggtgtgtatgggcaacattatatatatgcagtttttgccattttaaaagtaatggcaaaaaccacaattacttttgcaccaacctaataataattttagaagaagtagttttgtaaataacgattaaggcaatgatattcaaagaagacagtcagaattgcatataccttagttaaacagacttaacattctttatgacttaacagatcgtaagaaagatctagtgaagttacaagcaggagagtatgtatctcttgggaaagtagaagctgcactgaagaattgtccacttattgacaacatctgtgcttttgccaaaaggtaactttccaaagttgtattttttgtttcgtaagtcaaaagatatttagaaaataatgtgattacatattatcataagggtaacatagtcttctcttagaattttcatcagatctggggaattgtacatttatgtaagttagtgaattcaacagcttaaagatcattttagataactcagacgtgttaactatttattggacacctgcatcttgctaaatacttagctatgcaacaagttatttcatttaacatccatgacaactgagacttagtataagtaattttcccaaaaatgtaacacaactactacatgttgagatgaattttgaacccaagtttttctaaatcaaaagcctaagagattgagccattttctttatatgttgatatgtcttatttttatgggttttattcttttttaaaaattgtaattgtggtaaaaagcatataacgtaagatttaccatcttaaccatttctaaatgtacagttcagtagtgttgtgtatatttacattggtgtgcagccaatctccagacctttttttcttgcaaaatggaaactctatacccattaaacagcaactcctattcctcctccctccttcccctgggaaccaccattctactttctgtttctatgaatttgacttctctagaaatctcacacaagtagaattatacagtttttgcctttttgtgattggcttaattcccttagtataatgtcctcaaggattatccatgttgtagcatatgtcagaatttccttcattttgaaggcttaacaatattccattgtatccatataatgtattttgtttatatattcattgtcagtgcacattttggttgcctccccctcttggttgttgtgaataatgctcctaggaaaatgcgtatgcaaatatctctttgagatcctgctttcaattatgtggatagatacctagatttagaattgctggatcatatgacagttctatttttaattttttaaggaactgcaatactgttttccatagcaacagcaccatttttacatttcctacaacagtacacaaacattctagttcctccacttcttcactagcacttgtttgttttatatagtagtcatcctcatggatgtgaggggatattttgttttagttttgatttgtattttcctaatgattagtgccactgagcaccttttcctatgattgttggccattcatatattatcgctggagaaatgtctattcaagttctttgttcattatttaattgagctatttggttttttgttactgagttgtggaaattatatattctgtttattaaccccttatcagatatatgatttgcaaattttttttttctattccatagattgcctttttactctgctgattgagtcttttgatacacacaagtttttagttttgttgtagtcccagttatctgttttttgcttttgttgcctttgcttttggtgtcacacccaagaaatattgccaaatctattctcataaagtgtttcttctgtttttttttttctagcagttttatagttttatcagattggtgcaaaagtaattttggtttttgccattaatgtcaattacttttgcaccgacttaatagctcttcgatgtttagatttttgatccattttgagctaatttttgtatatgttgtaaggtgaaggtccaccttcattcattgcatgtggatatccagttttcctagtaccatttgttgacgagactgtcctttcctcattgagtggtcttaacacccttgtcaaagatcgtttctccatagatacaagggtttacttctagtttctctattccattggtctatatgtccttctttatgctggtactatgggttttatcatttcctaatgaaactttaataaataagagaaatatatatttggaattatctgtactgtactatgtcattgactagtttatgaataacttttctcaatgttttcatttctattttattttctgtttttttagtgatcagtcctatgtgatcagttttgtggttcctaaccagaaaaggttgacacttttggcacaacagaaaggggtagaaggaacttgggttgatatctgcaataatcctgctatggaagctgaaatactgaaagaaattcgagaagctgcaaatgccagtaagtaagaaattgctagactggtatagtccctaaaagtcatctaatgatgtcttttgcattaggctcttcaatatgtttgctttaataataaaatacaggattttaagaaacctatttcttaaatatgtataatggatttccatgttggaaggatccttcaatgtcatatagtagaataacctatgtagttctttattgcatgtttcaacatctttcccaaagtggtcatctagcctgtgtttggaatggtccatctttgggtagatctgttatataaatctactttgtgtctgtaaagcagaaattagtaactctaagtttagtaaatagtgttataaccatgattatgctttgtgtgtatactgtggctctgtaaatggactatcttcagatggtacattaataaccaattggagaaaatctgcttatatagtatatgccaggaattgtgttacacactaggaatacagaaagtagtaagactcatttcttgctctcatgtagttcattatcaggtgagaggggcacatgagagagacaacaatcttaacagcaatagagagatgaacagagaatcatggtaccacagatgagggtacctaacctacttgggaggacatggaagagatgtcacttcagctcatccttaagggttaattagaagttaactaggttgggcattctaggccaagaagcaacatgagaaaggcaaataggtatgaaaaggatgatgtgtgcagggaactacaagggagtctggtgttaccggtacagtgcaaagtatgaggtaaggctgtagaggttagcagaggccaagttgtgtagtaccttctatgcttgttcagaaatttggatgtaatcctgtagacagtgaggagccattggcaggttttactaggttagtgatgtggtcaggtttgcattttggagagatgcagtcactctggaggccatgctgcagatgaatttgagggggactggactgaggcagaaggccagttgaagaggactgtaggagatacctagactggggggtggtgagtaatgagggcgtgaagcagggaatcaggaaatgtttatgaagcaaaattggcacacttcagtgattaattggataacatagataagggaaaagaggagtctaggatagcccccagatttgtagctgaagcgacaaggtaaatactactactgattgagctagaaaatacaagaggaagagctggcatatacaagaagatgatgaggtcagtatgggatacatgtagtttgaaacacgttttgacaaccccatcaaaaagtgggcaaagaatatgaacagacacttctcaaaagaagacatttatgcagccaacagacacatgaaaaaatgctcatcatcactggccatcagagaaatgcaaatcaaaaccacaatgagatgccatctcacaccagttagaatggcaatcattaaaaagtcagggaacaacaggtgctggagaggatatggagaaataggaacacttttacactgttggtgggactgtaaactagttcgaccattgtggaagacactgtggtgattcctcaaggatctagaactagaaataccatttgacccagccatcccattactgggtatatacccaaaggattataaataatgctgctgtaaagacacatgcacacatatgtttattgcagcactattcacaagagcaaagacttggaaccaacccagatatccatcaataatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatattctcactcataggtgggaattgaacaacgagaacacttggacacaggaaggggaacatcacacactggggcctgttgtggggtggggggacgggggagggatagcattaggagatatacctaatgttaaatgatgaggattaatgggtgcagcacaccaacatggcacatgtatacatatgtaacaaacctgcatgttgtgcacatgtaccctagaacttaaagtataaaaaaataaaaataaaaaacacgttttggataatcaaagttaaaatgtccagcaggcggttgtgtgtagtccaaatcttattgggagaggcctggactctgctatagactcggggataattgaaaccacgaaagtagatgggccaaccttgggtgagattgtaaagggagaacaggaggctgtggatgggtctctggataacaccagcatataaggaatggatgaagaaagagatgtgtgtgggaagcatgattggcaagatgccaggagagcaatgcccatgcagaccactgctaagagagtttcaggaaagagagtaatcaacagttttacattagcagaaaggactgacaaagcttattggaacattgattggaaaattaaagagattaaaaattaatgctcaagttcaatagtaggctttttttttttcttttttcccaacgagggattccatgtgggtggctgattttataacctttttttaagtttcagttttatcagtataacaagtatatatagtttaaaaaatgtcagtattaaggacttgcaacaaaaagcagcccatattgtatccctcttttccccaagtctcatctgtcttcaactttagttgtttttttaaagtttctggcattcgtctccatttttctaaagaaaatggttatgttgctccttcttgaatttttcatttgcgatgttatggacttttatggacctctaaccatagaagatgatttacctttcttatgaccattctccttgccttccctaccacactttttcttttccaatagatagtacaatttgcattttacacccaggtttccgttatgattatgaaaatattcacagctgaactacatagtgttttatgattatatttcctttcttggacaattttttgtgtttccctggatcttaaaatttcctctcttcattagttttttgtatactattcttaactcttccactaaactctgttaaaattgtaaaaattctccctaatacaggaaaggatagcatgtctgtatttttgttctcggagacatacttcttagagccctttatcctcatgctgaaatttagactatttgcttccaaaggcttccctttactatcatcctgggaatttcctttgcttctctcctatgttggatcctgtttcctggatctcatatctgtctctttcctggtttactcgccggtttgggtagagcacatccttcagcagcttcctgagaaaggtgcatgggaggtaaatttttgagactgtgcttgcgtgtctgaatatgtttttattctgtcctcacccttgagatgtgtcttggcatattttagagtgataaattctaaatcatttttcctgaatactttgcagacttggctttgttgtcttccagctccagtgttgcatcctgattcccattcctttgtgtatgatctattttatctctcctagctttcagagtcattatgttaatttctggtgttttgatagttcataatgatgtatcttagtgtgggtctttgatcatttatcattgtgcatacttgctgtgggccctttccatatggagatctctgcccttcagttctgggaaatgttaatttatcttttgtttgttcatttgtttttttccccataattccccccaccctgtgtgtctgtttctgagactacttttatatggctgttggacttccagctttcatcctctaattttattatcctttttaaaattttctatttctctttttgttttatattctggcagagtctctcaactttatcatctcttctgtctactgaatttccaatttccactatcagaattttaattttcaagagcttgttcctgtcctctcagtgttccttttaatagcaccctgttgctctttcatggatgcagtcaatgcattgtctcttattcctctgaggatattaaaaggaatcctttttatgtagttttcttctcctgttattgtctcttttacctccaagttgcactttatgcttgccttggtcattgagtcccaagtgtctgctgatccttgtatgtccatattcaggaaccaggtactaaaaaactgtttggaaagcttactgggcttcactgaaaaggcattccaacgttagtgtctttttctcttaagtcattctgtttctccaaaggagatttctccagtcttttgcccgggcaatattagcctgactgccagaattctggtagccaaaagaggtaaaggagttattgagggggatgggagagcagtgggtctcaccctcactgaatccttctcttttcagccttactccctccttctgttgtacctaatgtccatgagtcccgagtctctgcttcagtttttccaaaaagtagacctgcctacaaatggctttgagaagagcagcatagggtgcgggagaacttttctctaaacaggctggagaccagtgctgctctttccagctttacccctcatctcttatcttcagaggcacaggcttagtgggcacttgcccgggctctactatgagggcagtttgctgcttgttggcaacctcttttgttggtagttgctttggcttcctcagccctaagttaattaccacaaattcctttgctttttgtcttctaagattttgttgcactttctcattcagtgcccattttctcttgtttcactttttgccttgtggttaatacctttttcatttttaaattattctaaacaatttaaattcttttttaggcagaacagagaaaaactatatactcttcgtgttttgttggaagctgttaacctaatttcaacccattgtttttctcttacaaataaaaatatcatttttctgattataggttatctatattcattataaaatattggacaacagaatattacaaagaaggaagtaaaaatcacttgagagtagtttatctttgggtggcaagattacattttggtatatatacttaagctgtcaacataatcgaagtttttctgtgtcagtaaatagaaaattacggtatcattttaaatactaaatagtcccagtgcataaatagccatttaagtccctattagatttttaggtgaatttcaccttcttccccatcactgtaaacaaatataacacgaatcttgtatactccattattttcttatgtgattattttcttagtgtgaattcctagaaacagaatttctgagtcaaagagaatatatatatatatattttttcaaataaatttttttaaaaattattattatactttaagttttagggtacatgtgcacaatgtgcaggttagttacatatgtatacatgtgccatgctggtgtgctgcacccattaactcgtcatttagcattaggtatatctcctaatgctatccctcccccttccgcccaccccacaacagtccccagagtgtgatgttccccttcctgtgtccatgtgttctcattgttcaattcccatctataagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggctggttccaagtctttgctgttgtgaatagtgccgcaataaacatacgtgtgcatgtgtctttatagcagcatgatttatagtcctttgagtatatacccagtaatgggatggctgggtcaaatggtacttctagttctagatccctgaggaatcgccacactggacttccacaatggttgaactagtttacaatcccaccaacagtgtaaaagtgttcctatttctccacatcctctccagcacctgttgttccctgactttttaatgattgccattctaactggtgtgagatggtatctcattgtagttttgatttgcatttctctgatggccagtgatgatgagcattttttcatgtgtcttttggctgcataagaatatatattttaaagacttttttcctcattgccaaattgctgcctctccccaggaaaactgaaccggcttatattcctatcagagatatatgaatatacctatttctctaactgggctcctattatttctatttattaaaaatgttaactacttaggttacattttggtttaaaaatatagtttatagtaatagtttttctacctgaaaactaatttctccccaagaataattttctgaattctagacactgtgaagttttaaataacaatggcctgttaacataatcagattgaaaaagcttatttattttatacctataaaaacagtgtgacatgtattttatacttacaaaaatagtgtgacataatatttccttcttcaaggtggttttgttacaatattattgatataacacacttttatattaatgaaccaggctcccagaaccttttttgatacaaagcctgatttgctctcaatatagtatttctaaaaatatatagtattttctttaggtatttaagtatagcatttcaaatatagtattttctttaaatatagtatttcaagaaatatatagtatttcaaccaaaaggctaatcatcagaggtgcactgtagttactcttattcatcctctgaatatattaatggattagaatgtgacttgaataattttccattgcatatttaattgtgtagaagcaacaatgggggaagtcaaactgtatcccactttgttagaaggcagaataaaatcctaggacccactaggttctcataactttcctgtgcttagagtgaggcatgtaactcatgatttggataatgagtggtaatcatgagctaaatgtataaatcataaaccttttgtgccacaaaggatttatcttgccaacattttgcaaattataatttcagagacttatgcaaaaaagtgtgaaatagttttgattgtattcagcaaatctgtcagaaattatacatctttcatagcaggcctcttcatattttaagtataattgtgaggtatacatagtatcataagaatgcaaaatacttgtttttgggtgatttgagcaactactaatggctatgaaaattgctatttgctgccacctgcaagtcacatttcataatgttctagttaattcagataaaaatgccacatttttgtttgttttgtttgtttttccttctcctaacctttctcacttgttggcaatttattctatttacaggaatctgtgatagtccattgcttcctatggcttggagtattagataatgtttaggagttttcaagatgaaacttctatagcagtctttatttttttggctttaaagtaggaatttaactaagattgttttcagcctgctttcatttgcttgtgtgcaactgaaataatgtgtttgccttgtcccaattttgtcagtgtttctggactaggacctatgtatgtaagaaaagtaaaatgaaataaaaaattggggggccaaatctgtagctgagaatttaactgtttccttgagttccaaatgtgacgttgggagcagataagcttattttatgaaactctgtgtaactgagctgtactttaataacagagtagacctggttaattcaagcaagttttatgttcctttacgacccattcaggcattatttttaggaagttggttgtaatttatatttaaaagattatttttcatactcaactttatatttttctgtcattttagtgagaaactcactagttcaatcaagctttcataaaacgtagactagtactagaaaagaactttggtgaatgtgagttctttgtgcttgccactgaaaccaaatcatttctaaactcgtctaggctattttgtagtagtttttaaaaatgtgcgaatgtttgcttcttggcaattgctgttttaaataatcacataaaataacattttatgttgattaacataacatctgttgattaatattactgttaataggcctccataatttaaagaattacccttgtagtcataataaataacttgatggcatataatttatggaatttaaaagtattaatactgtattaattacctttatgtccttccttatattttgccaatatgtattaagttgtataactcaaatacaatattcattgcatcagtttttataccatttaaagatatgaaattcacaatccccttttttatctgcatttgaatatatagtaaagtttataaagaatatttgtctagagacttaattttctgtagaatgaattaataaacttgtatgtatttatggagggctctcaaccctatggatggcagtgaaaaaatcaaagaccttgcttttatggagcttacattttagctccatggtgaaacaaatatataatatgttgggtggtgataactactttgaacaaagcatagtgttaagaaggtatagagagacaaagggacttctcttttgtgtatttctttatttattattatactttaagttttagggtacatgtgcacaatgtgcaggttagttacatatgtatacatgtgccatgctggtgcgctgcacccactaacttgtcatctagcattaggtatatctcccaatgctatccctccccccttccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccctggtgtatatgtgccacattttcttaatccagtctatcattgttggacatttgggttggttccaagtctttgctattgtgaataatgccgcagtaaacatatgtgtgcatctgtctttatagcagcatgatttatagtcctctgggtatatacccagtaatgggatggctgggtcaaatggtatttctagttctagatccctgaggaatcaccacactgacttccacaacggttgaactagtttacagtcccaccaacagtgtaaaagtgtccctatttctcgacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagcaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcccatgcctatgtcctgaatggtaatgtctaggttttcttctagggtttttatggttttaggtctaacgtttaagtctttaatccattttgaattgatttttgtgtaaggtgtaaggaagggatccagtttcagctttctacatatggctagccagttttcccagcaccatttattaaatagggaatcctttccccattgcttgtttttcttaggtttgtcaaagatcagatagttgtagatatgtggcgttatttgtgaggcctctgttctgttccattgatctgtatctctgtgttggtaccagtaccatgctgttttggctactgtagccttgtagtatagtttgaagtcaggtagcgtgatgcccccagctttgttcttttggcttaggattgacttggcgatgctggctcttttttggttccatatgaactttaaagtagttttttccaattctgtgaagaaagtcattgatagcttgatggggatggcattgaatccgtaaattaccttgggcagtgtggccattttcacgatattgattcttcctacccatgagcatggaatgttcttccatttgtttgtatcctcttttatttccttgagcactggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgatcgccctggccagaacttccaacactctgttgaataggagtggtgagagagggcatccctgtcttgtgctggttttcaaagggaatgcttccagtttttgcccattcagtataatgttggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatactggattacatttattgatttgcgtatattaaaccagccttgcatcccagggatgaagcccacttgatcatggtggataagctttttgatatgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctcattttctattgattggaatagtttcagaaggaatggtatcagttcctccttgtacctctgatagaatttggctgtgaatccatctggtcatgggcttttttttgttggtaggctattaattactgcctcaatttcagcactttttattggtctattcagggattcaacttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgctgatcctttcaaaaaaccacctcctggattcattaattttttgaagggttttttgtgtctctatttccttcagttttgctctgatcttagttatttcttgccttctgctagcttttgaatgtgtttgttcttgcttctctagttcttttaattttgatgttagggtgtcaattttagatctttcctgctttctcttgtgggcatttagtgctataaatttccatctacacactgctttgaatgtgtcccagagattctggtatattgtgtctttgttcttgttggtttcaaagaacatctttatttctgtcttcatttcgttatgtacccagaagtcatccaggagcaggttgttcagtttccatgtagttgaccggttttgagtgagattcttaatcctgagttctagtttgattgcactgtggtctgagagacagtttgttataatttctgttcttttacatttgctgaggagagctttacttccaagtttgtggtcagttttggaataggtgtggtgtggtgctgaaaaaaatgtatattctgttgatttggagtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttttaggtcactcacgacttgctttgtgaatctaggtgctcctgtattaggtgcatatatatttaggatagttagctcttcttgttgaattgatccctttaccattatgtgatggccttctttgtctcttctgatctttgttggtttaaagtctgttttatcagagactaggattgcaacccctgccttttttttgttttccatttgcttggtagatcttcctccatccttttattttgagcctatgtgtgtctctgcacgtgagatgggtttcctgaatacagcacactgatgggtcttgactctgtatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagtggctggtaccggttgttcctttccatgtttagcacttccttcaggagctcttttagggcaggcctggtggtgacaaaatctctcagcatttgcttgtctgtaaagtattttatttctccttcacttatgaagcttagtttggccggatatgaaattctgggttgaaaattcttttctttaagaatgttgtatattggcccccactctcttctggcttgtagagtttctgccgagagatccgctgttagtctgatgggcttccctttgagggtaccccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatattctacagagtgttttccaacttggttccattctccccatcactttcaggtacaccaatcagatgtagatttggtcttttcacatagtcccatatttcttggaggctttgctcgtttctttttattcttttttctctaaacttccttctcactccatttcattcatttcatcttccatcattgatagcctttcatccagttgatcgcatcggctcctgaggcttctgcattcttcacgtagttctcgagccttggctttcagctccgtcagcttctttaagcacttctctgtattggttattctagttatacattcttctaaatttttttcaaagttttcaacttctttgcctttggtttgaatgtcctcccgtagctcggagtaatttgattgtctgaagccttcttctctcagctcgccagagtcattctccgtccagctttgttccgttgctggtgaggaactgcattcctttggaggaggagaggcgctctgctttttagagtttccagtttctctgctctgttttttccccatctttgtggttttatctacttttggtctttgatgatggtgatgtacagatcggtttttggtgtggatgtcctttctgtttgttagttttccttctaacagacaggaccctcagctgcaggtctgttggagtacccggccgtgtgaggtgtcagtctgcccctgctggggggtgcctcccatttaggctgctcgggggtcaggggtcagggacccacttgaggaggcagtctgcccattctcagatctccagctgcgtgctgggagaaccactgatctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaagcaagcctgggcaatggcgggcgcccctcccccagcctccctgccaccttgcagtttgatctcagactgctgtgctagcaatcagcgagactccgtgggcgtaggaccctccgagccaggtgcgggctataatctcctggtgcaccgttttttaagcctgtcggaaaagcacagtatttgggtgggagtgacccgattttccaggtgacccgtttctttgactaggaaagggaactccctgaccccttgtgcttcccgagtgaggcaatgcctcgccctgcttcggctcgcgcatggtgcgcacacccactgacctgcgcccactgtctggcactccctagtgagatgaacctggtacctcagatggaaatgcagaaatcacccgtcttctgtgtcgctcaggctgggagctgtagaccagagctgttcgtatttggccatcttggctcctcccccttctcttttgttatgagtggtcagggatgtcctctccggggtggtggtatttgagcagacatatggataaagtatggaagtgacacacaactttattgagaaagaccatctcaggcaaatataaagtctctgaagaggaagatgtgtgtgtatgtgtgtgtgtgtgagtataaataatgtgtatatgtatgtatattttaataaccacatagactaaaactatccaactgaaacaacttaggtatactttgagaaatataaaatgaaattgtaaggtagaggtagcattaataaactatctagtataccattaaataagtttgtggtgattggtgattcaacacccgaatcatctaggtaaatcctgaaaaactcatattttattaattgcttctccttccccttctttccccgtccccactcctttctcgtctctttccccccctctccttttctcccatctttcacttctaatttcagtgaaattggagcgatttgaaattccaatcaaggttcgattaagcccagagccatggacccctgaaactggtttggtaactgatgctttcaaactgaaaaggaaggagctgaggaaccattacctcaaagacattgaacgaatgtatgggggcaaataaaatgttgttgtcttattgacagttgtgcaggaggtagcctggtggttttcaacctctagaattttaagcctttgttgaactgttagaatgtaaggtatatcattctaaagatagagtaaaaagaaaacaaaaccaaaagttattaaaattgttgtccggtttactttaacttagttttgcatagttctagtgcagctgaaattgaaaagttatttccctttagctgtgttattatagagcagaaattctgtttttaaaaattagcctaagatatacttgtttttgtaaagaaaaatatttaatgttgaacaaaataaattggagttggagtagaatgtagtttgaggaaatttgcagcttccaatgcctcttgtcttcctatttcagaagtttaaatattaagcatgacagaaaatatgtattaacactactcaaagcaaaagtgctgcagggctttaaaattctcttccaaccatttatcttgaaggaaaaattcaatagtaatataatacacaaaatcaaataataccttagaaggtattaagattataattgttgcataggttagatatagagtcattgtaatgttgtgaataattacagtgcctaaaataagaatagaacaacatatacaacaccaaaaaatatctagtaatatatttaaagggaaattgagctgctttttttgaaactttgagatctaaaaataactgtaattatttgaatgactaagaggaaagtacattttttgaaatgctgaaaattgcctttctgtgtttattcaaactgaaaagctgagaccaagagcaaggaaggtaaaaagttaacaggcaaacattttctcttagaaaaggtgataaaatcataagtatttggaattagaacccttgcacagcactgaacctgggaaagagatttaaactctgaatttatctttgataacagggattgattttaaaatgtacatgtattaaattacatttgtaatttaaggtctgtttgctgttgctgattttattcttgatcagtagtttgcatttcagaaagcctttcattttgctttaattttagcaaagcgggttataatgaatgacttccccaatatcttgcttgaacttacaggtgattaacttggatgagttttgggaagttaaagggaagaaaacactgttatcattttttcctgtttgggaagagcttagaaactggaaatactagatttgggagaagggcagagttacttgataagggactgatgtttgtgcagtaacttgggagtgtggtttctttttgaatctttaattaaaacctgggattatatatccctgataaatattcacacttgaaccatagttactgtaaaatgcaaaaaatcttaatactgttattctttgcactttttcttaatcattttttatatatatgcatatatatatgtgtgtgtgtgtgttgcttatgttgttttgtacagatgtgggccaccattgcaacaaaatacattctttttgctctaaaatatttatgaagaaaatacttaaatgttatgtatatggtggtaataagggaaaaatcaagtattataaacaagaatgaaggtttttgtaaagatttctgttcagcgttttgcaaggtaaaattttaggcaagttttccctgaagttatgtgtatgtgagtattctcattcttcccaacttgcctttgaagagtgaaataccattattatcaagtagactactgttcagcttttattcctgccctgctgtttatcccttaagaatgagtttcttagacttttccaatatgtgattttttttcccatttagaatggtgattttaaatgtgtgagtgcatgtactatcttatctcagatatttgcacccccaatctgcccccaactcccaaaagctagaacactgccaactgatctgttataggtcctttagaaacacataattaacacttaaggttgggtgctgctaattctttgcaaaaatccaaatattgttaagggaccagggagatgccactaccccttgattttccatctaaaaatatacatgtttatgtaaacaaatctttccatatccatagtgacttttcaagtatttaagcctaaagattttgatctcacatttttatacctgtttaaattgctcacagttattacatacacatcagccatcaactaaagttgtactttaaaaatttactacaatatgtacatttctaagtcaaacacttgtgacttttgctttaattccatgaatgttcctgcctccttgatatttgtatttattctttttttctctagagtagaggtataattgtgtgatatttcagaaatacagataaatgattcaaaaagtcacagttaaggagaatcatgtttctttgatcatgaataactgattagtaagtcttgcctatattttcctgatagcatatgacaaatgtttctaaggtaacaagatgagaacagataaagattgtgtggtgttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaagccaa

SEQ ID NO: 12612 - DNA, 5709 bp, Homo sapiens
ttcattccttctttttttttttttttactgtaagttctagggtacatgtgcacaacgtgcaggtttgttacgtatgtatacatgtgccatgttggtgtgctgcacccattaacttgtcatttacattaggtatgtctcctaatgctatccctcccacctcccccctccccaccccacaacaggccccggtgtgtgatgttccccttcctgtgtccaagtgttctcattgttcagttcccacctatgagtgagaacatgcggtgtttgtttttttgtccttgcgatagtttgctgagaatgatggtttccagcttcatccatgtccctacaaaggacatgaactcatccttttttatggctgcatagtattccatggtgtacatgtgctacatttcttaatccagtctatcattgttggacatttgggttggttccgagtctctgctgttgtgaatagtgctgcaataaacatacgtgtgcatgtgtctttatagcagcatgacttataatcctttcggtatatacccagtagtggtatggctgggtcaaatggtatttctagttctagatccctgaggaatcaccacactgtcttccacaatggttgaactagtttacagtcccaccaacagtgtaaaagtgttcctattctccacgtcctctccagcacctgttgtttcctgactttttaatgatcaccattctgaatggtgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgtttttttcttgtaaatttgtttgagttcattgtagattctggatattagccctttgtcagatgagtagattgcaaaaattttctcctattctgtaggttgcctgttcactctgatggtagtttcttttgctgtgtagaagctcttcagtttaattagatcccatttgtcaattttggcttttgttgccattgcttttggtattttagacatgaagtccttgcccgtgcctatgtcctgaatggtattgcctaggttttcttctagggtttttatggttttaacttaacattaaagtttagttaaagacttagcttaaagtttagttaaaaacattaaagacttaacatttaagtctttaatccatcttgaattaatttttgtataaggtgtaaggaaaggatccagtttcagctttctaaatatggctggccagttttcccagcaccatttgttaaatagggaatcctttccccatttcttgtttttgtcaggtttgtaaaaaatcagatggttgtagatgtgtggtattatttctgagggctctgttctgttccattggtctatatctctgttttggtaccagtaccatgctgttttggttactgtagccttgtagtatagtttgaagtcaggtagcgtgatgcctccagctttgttcttttggcttacgactgacttggcaatgcaggctcttttttggttccatatgaactttagagtagttttttccaattctgtgaagaaagtcattggtagcttgatggggatggcattgaatctataaattaccttgggcagtatggccattttcacgatattgattcttcctatctgtgaacatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgattttctatcctgagactttgctgaagttgcttatcagcttaaggagattttgggctgagacaatgaggttttctagatacacaatcatgtcatctgcaaacagggacaatttgacttcctcttttcctaattaaataccctttatttctttctcctgcccgtttgccctggccagaacttccaactatgttgaataggagtggtgagagaaggcatccctgtcttgtgccagttttcaaagggaatgcttccagtttttgcccattcagtatgatgttggctgtgggtttgtcataaatagctcttattattttgagatacatcccatcaatacctaatttattgagagttcttagcatgaagggctgttgaattttgtcaaaggccttttcggcatctattgagataatcaggtagtttttgtctttggttctgtttatatgctggattacatttattgatttgcatatattgaaccagccttgcatcccagggatgaagcccacttgatcatggtggctaagctttttgatgtgctgctggattcggtttgccagtattttattgaggatttttgcattgatgttcatcagggatattggtctaaaattctctttttttgttgtgtctctgccaggctatggtatcaggatgatgctggcctcataaaatgagttagggaggattccctctttttctattgattggaatagtttcagaaggaatggtaccagctcctccttatacctctggtagaattcggctgtgaatccgtctggtcctggactttttttggttggtaagctattaattattgcttcaatttcagctcctgttattggtctattcagagattcaactttttactggtttagtcttgggagggtgtatgtgtccaggaatttatccatttcttctagattttctagtttatttgcatagaggtgtttatagtattctctgatggtagtttgtatttctgtgggattggtggtgatatcccctttgtcattttttatttcgtctatttgattcttctctcttttcttcttattagtcttgctagtggtctatcaattttgttgatcttttcaaaaaaccagctcctggattcattgatttttaaaggttttttgtgtctctatctccttcagttctgctctgatcttagttatttcttgctttctgctagcttttgaatgtgtttgctcttgcttctctagttcttttaattacgatgttagggtgtcaattttagatctttcctgctttctcttgtggacatttagtgctataaatttccctctacacactgctttgaatgtgtcccagagattctggtatgttgtgtctttgttctcattggtttcaaagaacatctttatttccgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacctttgctgaggagtgctttatttccaaccatgtggtcaattttggaataagtgcgatgtggtgctgagaagaatgtatattctgttgatttggggtggagagttctgtagatgtctattaggtctgcttggtgcagagctgagttcaattcctggttatccttgttaactttctgtctcgttgatctgtctaatgttgacagtggggtgttaaagtctcccattattactgtgtgggagtctaagtctctttgtaggtctctgaagacttgctttatgaatctggatgctcctgtattgggtgcatgtatatttaggatagttagctcttcttgttgaattgatacctttaccattatgccattatgtaatggccttctttgtctcttttgatctttgttggtttaaagtctgttttatcagagactaggattgcaacccctgcctttttttgttttccatttccttggtagatcctcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtggaatttgatactgtcattatgatgttagctggttattttgctcgttaattgatgcagtttcttcctagtctcggtggtctttacaatttggcatgtttttgcagtgactgttactggttgttcctttccatgtttagtgcttccttcaggagctcttgtagggcaggcctggtggtgacaaaatctcagcatttgcttgtctgtaaaggattttatttctccttcacttatgaagcttagtttggctggatatgaaattctgggttgaaacttcttttctttaagcatgttgaatattggcccctactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttcttgaggagtatctttgtggtgttctctgtatttcgtgaatttgaatgttggcctgctttgctaggttggggaagttcttgtggataatatcctgcagagtgttttccaacttggttccattctccctgtcactttcaggtacaccaatcaaacgttgatttggtctgttcacatagtcccgtatttcttggaggctttgttcatttctttttattcttttttctctaaacttctcttctcccttcatttcattcatttgatcttcaatcactgataccctttcttccagttgatcgaatcggctactgaagcatgtgcattcgtcacgtagttctcgtgccatcgttttcagctccatcaggtcatttaaggacttttctacactggttattctagttagccatttgtctaatcttttttcaaggtgtttaagttctttgcaatgggttcgaacttcctcctttagcttggagaagtttggtcatctgaagccttcttctctcaactcatcaaagtcattctctgtctagctttgctccgttgctggtgaggagctgtgttcctttggaggaggagaggtgctccgatttttagaattttcagtttttctgctctgttttttccccatctttgtggttttttctacctttggtctttgatgatggtgatatacagatggggttttgatgtggatgtcctttctgtttgttagttttccttctaacagtcaggaccctcagctgcaggtctgttggagtttgctggaggtccactctagaccctgtttgcctgggtatcagcagcggaggctgcagaacagctaatattgctgaacagcaaatgttgctgcctgatcgttcctctggaagtttcgtcttagagggctacccggccatgtgaggtgtcagtctgttcctactggggggtgcctccccccaagttaggctacttgggggtcagggacccacttgaggaggtagtctgtccgttctcagatctcaaactccgtgctgggagaaccactactctcttcaaagctatcagacagggacatttaagtctgcagaggtttctgctgccttttgtttggctatgccctgtccccagaggtggagtctacagaggcaggcaggcctccttgagc

SEQ ID NO: 12613 - DNA, 6061 bp, Homo sapiens
accattttgtttttttttttttttcttttttttttttattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattcgggttggttccaagtctttgctattgtgaataatgccgcaataaacatacgtgtgcatatgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcgtaaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaacttgaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttgactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaatttccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggctttttctgcatctattgagataatcatgtggtttttgtctttgcctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttattggtctattaagagattcaacttcttcctggtttagtcttgggagagtgtatgtgtggaggaatttatccatttcgtctagattttctagtttatttgcatagaggtgtttgtagtattctctgatggtagtttgtatttctgtgggatcagtggtgatatcccctttatcattttttattgtgtctatttcattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccgcagagattctggtatgttgtgtctttgttctagttggtttcaaagaacatctttatttatgcgttcatttagttatgtaccagtagtcatttaggagcaggttgtttagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtccgcttggtgcagagctgagttcaattcctgggtatccttgttgactttctgtctcgttgatctgtctaatgttgacagtggggtgttaaagtctcccattattaatgcgtgggagtctaagtctcttcgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacctctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgatattgctcgttagttgatgcagtttcttcctagtctcgatggtctttacattttggcatgattttgcagcggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcccttaacattttttccttcatttcaactttggtgaatctgacaattatgtgtcttggagttgctcttctcgagaagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctgatttctttttattcgtttttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttgaaagttttcaacttctttgcctttggtttgaatgtcctcccgtagctcagagtaatttgatcgtctgaagccttcttctctcagctcgtcaaagtcattctccatccagctttgttccattgctggtgaggaactgtgttcctttggaggaggagagacgctctgcgttttagagtttccagtttttctgttctgttttttccccatcattgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtctgcccctgctggggggtgcctcccagttaggctgctcgggggtcaggaacccacttgaggaggcagtctgccggttctcagatctccagctgcgtgctgggagagccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgcccgctgctttgtttacctaatcaagcctgggcaatggcgggcgcccctcccccagcctcgctgccgccttgcagtttgatctcagactgctgtgctagcaatcagcgagattccgtgggcataggaccctccaagccaggtgtgggatataatctcgtggtgcgccgtttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccctccccacaccattttg

SEQ ID NO: 12614 - DNA, 6056 bp, Homo sapiens
ttattatttttttttataattgtgaagcttttttttttattatactttaagttttagggtacatgtgcaccttgtgcaggttagttacatatgtatacatgtgccatgctggtgcgctacacccactaactcgtcatctggcattaggtatatctcccaatgctatccctcccccctccccccaccccaccacagtccccagagtatgatattccccttcctgtgtccatgtgatctcaatgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatctgggttggttccaagtctttgctgttgtgaataatgccgcaataaacatacatgtgcatgtgtctttgtagcagcatgctttatagtcatttgggtatatacccagtaatgggatggctgggtcaaatggtatttctagttctagatccctgaggaatcgccacactgacttccacaatggttgaaccagtttacagtcccaccaacagtgtaaaagtgttcctatttctccgcatcctctccagcacctgttgtttcctcactttttaatgattgccattctaactggtgtgagatggtatctcacagtggttttgatttgcatttctctgatggccagtgatgatgagcattttttcatgtgttttttggctgcataaatgtcgtcttttgagaagtgtctgttcatgtccttcacccactttttgatggggttgtttgttttattcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcgaagatcagatagttgcagatatgcggagttatttctgagggctctgttctgttccattgatctatatctctgttttggtaccagtaccatgctgttttggttactgtagccttgtagtatagtttgaagtcaggtagtgtgatgcctccagctttgttcttttggcttaggattgatttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttttcagcttaaggagattttgggctgagacgatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagcatttttagcatgaagcgttgttgaattttgtcaaaggctttttctgcatctattgagataatcatgtggtttttgtctttggctctgtttatatgctggattacatttattgatttgcgtatattgaacaagccttgcatcccagggatgaagcccacttgatcatggtggataagctttttgatatgctgctggattcggtttgccagtattttattgaggatttttgcatcaatgttcatcaaggatattggtctaaaattctcttttttggtggtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgagtagaggtgtttgtagtattctctgatggtagtttgtatttctgtgggattggtggtgatatcccctttatcattttttattgtgtctatttgattcttctctctttttttctttattagtcttgctagcggtctatcagttttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatatagtgctataaatttccctctacacactgctttgaatgtgtcccagagattctggtatgttgtgtctttgttctcattggtttcaaagaacatctttatttctgccttcatttcgttatgtacccagtagtcattcaggagcagattgttcagtttccatgtagttgagcggctttgagtgggattcttaatcttgagttctagtttgattgcactgtggtctgagagatagtttgttataatttctgttcttttacatttgctgaggagagctttacttccaagtatgtggtcaattttggaataggtgtggtgtggtcctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccatgatgtaatggccttctttgtctcttttgatctttgttggtttaaagtctgttttatcagagactaggattgcaacccctgcctttttttgttttccatttgcttggtagttcttcctccatccttttattttgagcctatgtgtgtctctgcacgtgagatgtgtttcctgaatacagcacactgatggatcttgactctttatccaatttgccagtctgtgtcttttaattggagaatttagtccatttacatttaaagttaataatgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaaactctcagcatttgcttgtatgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcccgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagagacactctgcgttttagagtttccagtttttctgttctgttttttccccatctttgtggttttatctacttttggtctttgatgatggtgatgtacagatgagttttcggtgtggatgtcctttctgtttgttagttttccttctaacagacagcaccctcagctgcaggtctgttggagtaccctgccatgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgacctgcccccagaggtggggcctacagtggcaggcaggcctccttgagctgtggtgggctccacccagttcgaacttcccggctgctttgtttacctaagcaagcctgggcaatggcgggcgcccctcccccagcctagctgccgccttgcagtttgatctcagactgctgtgctagcaatcagtgagactccgtgggcgtaggaccctccgagccaggtgtgggatatagtctcctggtgcgccgttttttaagccggtctgaaaagcgcaatattcgggtgggagtgacccgattttccaggtgcgtccgtcacccctttctttgactcggaaagggaactccctggccccttgcgcttcccaggtgaggcaatgcctcgccctgcttcggctcgcgcacggtgcgcacacccactggcctgcactcactgtctggcactccctagtgagatgcacccggtacctcagatggaaatgcagaaatcacccgtcttctacagctcaccctgggagctgtagaccggagctgttcctattcggccaccttggctcctcccctt

SEQ ID NO: 12615 - DNA, 42488 bp, Homo sapiens
gacgatggggttttctaaatatacaatcatgtcatctgcaaacagggacaatttgacttcctctttccctaattgaatatgctttatttctttctcttgcctgattgccctggccagaacttgcaacactatgttgaataggagtggtgacagagggcatccttgtcttgtgctggttttcaaagggaatgcttccagtttttgtccattcattatgatattggctgtgggtttgtcataaatagctcttattattttgggatacgttccatcaatacctagtttattgagagtttttagcatgaagagctgttgaattttgtcaaaggccttttctgcgtctattgagataatcatgtgttttttgtcattggttctgtttatgtgatggattacttttattgatttgcatatattgaaccagtcttgcatcccaaggatgaaagtgacttgatcgtggtggataaggtttttgatgtgctgctggattcagtttgccagtattttattgaggattttcgcattgatattcgtcagggatattggtctaaaattccctttttttgttgtgtctcctccaggctttggtgtcaggatgatgctagcctcataaaaagagttagggaggattccctctttttctactgattgaaatagtttcagaaggaatggtaccagctcctctttgtacctctggtagaatttggctgtgaatccatctgatcctggactttttttggttggtaggctattaattattgcctcaatttcagagcctgttgttggtctattcagagattcaacttcttcctgttttagtcttgggagggtgtatgtgtccaggaatttatccatttcttctagattttctagtttatttgtgcagaggtgtttatagtattctctgatggtagtttgtgtttctgtgggatcgatggtgatatcccctttatcattttttattgcatctatttgattcttctctcttttcttctttattagtcttgctagcagtctatcaattttgttgatcttttcaaaaaaccggctcctggattcaatgatttttttgaagggttttttgtgtctctgtctccttcagttctgctctgatcttagttatttcttgccttctgctagcttttgaatgtgtttgccctgcttctctagttcttttaattgtgatgttaggatgtcaattttagatctttcctgctttctcttgtgggcatttagtgctataaatttccctctaccctctgccttaaatgtgtcccagagattcttgtacactgtgtctttgttctcattggttttaaagaacatctttatttctgccttcatttcattatttacccagtagtcattcaggagcaggttcttcagtttccatgcagttgggtggttttgagtgaatttcttaatcctgagttctaatttgattgtgctgtggtctgagagacagtttgttgtgacttctgttcttttacatttgctgaggagtgctttacttccaactatgtggtcaattttagaataagtgtgatgtggtgctgagaatgtatcttctgttgatttggggtgtagagttctgtagatatctattaggccttcttggtccagagctgagttcaagtcctagatatccttgttaatcttctgtctcattgatctgtctaatattgacagtggggtgttaaaatctctcattattactgtctgggagtctaagtctctttttaggtctctaaggacttgctttatgaatctgggtcctcctgtattgggtgcatatatatgtaggatagttaactcttcttgttgaattgatccttttaccattatgtagtggtcttccttgtctcttttgatcttcgttggtttaaagtctgttttatcagagactagaatcacaacccctggtttgttgttgttgttgttgttgttgttgttgctttctatttgcttggtagatcttcctgcattcctttattttgagcctatgcgtgtgtttgcatgtgagatgggtctcctgaatatagcatactgatgagtcttgactctttatccaatttgccagtctgtgtcttttaattggggcatttagcccatttacatttaaggttaatattgttatgtgtgaatttgatcctgtcgttatgatgttagctggttattttgcccattagtttatgcagtttcttcatagcttggatattctttaccatttggcatgtttttgcagtggctggtaccggttgttcctttccatgtttagcacttccttcaggagttcttgtaaggccggtctggtagtgacaaaatctctcagcatttgcttgtctgtaaaggattttatttctccttcatttatgaagcttagtttgactggatatgaaattctgagttgcaaattcttttctttaagaatgttgaatattagcccccactctcttctggcttgtatggtttctgccaagagatctgctgttagtctgatgggcttccctttgtgggtaacctgacctttctctctggctgcccttaacgttttttccttcatttcaactttagtgaatctgacaattgtgtgtcttggggttgctctactcgaggaatatctttgtggtgttctctgtatttcctgaatttgaatgttggcttgccttggtaggttggggaaattctcctggatagtgtcctgaatagcattttctacactgtgttccattctccctgtcactgtccagtataccaatcaaacgtagatttggtcttttcacatagtcccatatttcttggaggctttgttcgtttcttttcactcttttttctctaatcttgtctacttgctttatttcattaatatgatcttcaatcactgatatcctttcttccacttgattgaatcagctattgaagcttgtgcttgcatcaagaagttctcatgccatggttttcagctccatcatgtcgtttaaagtcttctctacagtgtttattctagttagccattcgtctaaccttttttcgaagtttttctcttcgttgcaatgggttcaaacatcctcctttagtttggagaagtttgttattaccgaccttctgaagcctacttctctcaactcatcaaagtcattctccatcccgtcttgttctcttgttggcgaggagatgcaatcctttgaaggagaagtgacgctctggtttttggaattttcagcttttctgctctggtttcttcccatctttgtggttttttatctacttttgttctttgatgttgctgacctacagatggggttttggtgtgggtgtcctttttgttgatgttgatgctattcctttctgtttgttagttttccttctaacagtcaggtccctcagctgcaggtctgttggagtttgctggaggtccactccagaccctgtttgcctaagtatcaccagcgaaggctgcagaacagctagtattgctgtctgatccttcctctggaagcttcatcctggaggggcacccacctgtttcagttgtctgtcggcccatactgggaggtgtttcccagtcaggctacacaggggtcaggggcccacttgaggaggcagtctgtccattcttggagctggaatgctgtgctgagagaaccactgctctctttagtgctgtcagacagggaagtttaagtctgcagaagctgtctgttgccttttgttctactatgccctgcccccagaggtggaatctatagtggcagtaggccttgctgagctgggatgggctccacccagttcttgcttccaggcctctttgtttacactgtgagctactcaagcctcagcaatggaggacgcccttccccctatttcaatagatatttaaaaagcattcaagaaaattgaacatcacttaatgaaaaaaactctcaaaaaattggtgaagaaacatacttcaacttgataaggaccatgtatgacaaatccacagttaatatcatactgaatggggaaaaattgaaagcctttccactaagatctggaacaagacaagaatgcctactttcatcacttttattcaacattgtactgaaagtcctagctagagtaattagacaagattaaaaaaagtaaagggcatccaaactggaatgaagtcaaattgtacttgtttacagatgaaacaaacttatatttagaaaaacctaaacactcgactcagaaactactagaactgattaaggaattctacaagctataggatacaaaataaagctggagatatcacactatctgacttaaaattatactataaatctatagtaaccaaaacagcatgtactggtacaaaaacagacccatagaccattggaacagaatagagaacccagaaataaatccacacacttagggcaacttatttttgacaaagacatcaagaacatacattgggagaaaggataatctctaataaatagtgctgagaaaactggatatctgtatgtagaagaatgaaactggatctccatcttttaccacaaagaagaatcaactcaaaatggattaaagacttaaatgtaagacgtgaaactatgaaaccactaaaagaaaacactggggaaacactacaggacattgatctgggcaaagagattttgagtaagacctcaaaagcacaggcaacaaaggcaaaaatatacaaatgggattacatcaagccaaaaagcttctgcacagcaaaggaaatggtaaaagaagtaaagggataacctgaagaatgggagaaaatatttgcaaactctccatccaacaagggattaatatctagaatataaaggaaactcaaatgactcgataccaaaaaacaaacaatctggttttaaaaatggattaaatacctgaatcgacatttctcaaaacaagaaatacaaatggccagtagatatatgaaaaatggccaacatcactaatcatcagggaaagcaaatcaaaaccacaatgagataccatctcactcagttagaatgactgttatcaaaaagacaaaaaataacaaatgctggcggggatgtggagaaaagggaacatgcatacactgttggggaggaaagtagtacacagttatgggaaaagtatggaggttcctaaaaaaactaaaaataaaactactatatgatccagcaattccactgctaagtatataaccaaaagaaaggcaatcagtatctgaaagcaatatcttcactcccatatttattgcctcattattcacaatacccaagataaggaaccaatctaagtgtcccttaatgaataaattcataaagaaaatgtacctatacagaatggaatattatttgaccataaaaaatgaaaccttatcatttaaagcaacatagatggaactggaggtcattatggtaagagaaacaagccaggcacagaaagacaaacatcatgtgttttactcatatgggagagcttagaaggtggatgtcatggaaggaaaggatagaatggtggtcaccaaaggctgggaagggaaaaggaaagggaggtacgaagataaatggattaaggggtaaaaatatacagttagataaaagaaataagttctcgtattcactagtatagtagggaaattatagttaacaataattcattgagaagaattctaacatttccaacacaaagaaaaggtaaatgtttgaggtgatgtatatcccaatgatactaatttgattattacacattgtataaaggtatcaaaatatcacacatacccctaaaatatgtactactataatatagcaacaaaacattaaaaaaaaagaatacaagaagaagaagacccattttcgtggagggaatcagataataaaacaggacacatagtaggcaagttggtgatatgtgatttggaggaaaataaaacaatggagtcttagaagagagtcacaatttaaatagggaggtcagataaggccttacaactcagttgatctctgagaaaaggagagagggaaggagccatcttggtttctgggggcagagtacctggttggaggaaatagcaactgtgcagagcctgtagtgggaacctgcctagattatttgaggtctttgtggctggaagggagttagttaggggaagggcagggggactagaatgtattgttttatgggccattgtgggaaccttggcttttactcttaaggaaatgaggattttgaacagagttgtgacatactatggcttgtggtttagcagaaggtgatataaaaaatacatgtggtcttcatctccagtttctggcacagaattcctaaaacctttggaatttgctgagtgatgggagtgttttttgtatgtaaacaagatgattcaaggggtgggaaagccctagagagtttcagggtggggctggtcaccagaataacaaacccttgcttagagggttagaacttccagacttacctcctagctctagggagaggaatgggactgcagatggagttcattctccagtggccaatgatttaatcaaaactgcctatggaataaaagctccattaaaactctgaaactactagagtaggtgagcttccaggtggatgaacatattgatgtgctgggaagttcaactgcctggagaaggcacagaaattctgcacaccccaccctcaatcttccaatgccttcacctgtgcatctcttccctttggctgttcctgagttgtagcctttgtaacaaaactgtaatggtaagaatagcactttccttagttctgtgaatcaccctagtgaattatcaaactgaaggagagagagcagtcgtgggaactcttgaattagtagttggccaggaagaagtgcaggtagcctggggaccccatttgtggctgggccctgaagtacaggcagtcttgtgggacttgtagaacccttaacttgtggaggtctgtgctaactctgggtagttagtgtcagaaatgaattgaattataggaaactcagttggtatcagagaactagagaattggttattggaaaagagacaaaacaccgaatgactctgactcttgtgtggagggtagtaggaaggggaccaacagcagaagagtcagggagacaaaccagccacctaatgtaagtaactgggagagacagcagcagtcatgataagacatacttgtgatgcagtgtgggcaagccccaaatttggggcttagccagggagagttcttggcttcacccaggaaataattcaagggtgaggtggtggtggtagcagctgttattgaagtggcagtgtatggccgcagcagaggtcctgctccttgcagagcagggctaccccataaggcagtgcgcccagagcagcggctcaggggcagttctgcagtcacatttataaccacttttaattatatgcaaattaagggatggagtattcagaaatttctagtaaggggcagtaacttctcgtgttgccatggaaaggggtggtaaatcttaggcgttgccatggcaatggtaaactgacatggaacactggtggggtgtcttatggaaagctgctttccataagaccctgtcttaactagtcctcaatttggtccagtgtctgagccttcctcctacctcacttggattatggatgtattttgaagagaaaatcactgtgatttgcttatgggttccatctgggatgggagagaaagaggaattgagactgattcaaggaattgggcatgtggaaatacaatgtaactctcaatgccccagtgaaggaagtgtctctggagccctctggaaacatattgttaagggctgggttagcaggtcacacaagattgtcaaaagacaaaattacaacaaattcagtttgaagatcttaattggtttttatctgcaattctagaataaggcaacaactcataaaacaaaatgagtgttccgttgagccaagcaaaggaggttggttttatagacagtaaagggctgaggaaagcataaacagaacaaaaaatgggttggttgtttcaaagttacttttcttctaaagcagaaagaactttttaaaattatgctggcttaaactggcctgtttggagatttggttattctctctctctcctgatttcttggaaagttagattaacagcttaatttcagcttggtggtatggaacttcagcaagagtgacttcagtttgatttggtttgttgggcctggtgcaaaagttcagttcaaacaaataaatagcctcctctaaatcttatttagcataataaatcccttccaacactcccatcctcctatgcctgtgaatttcttctcctatattgtaccaaggaatttctggcatttacactacattcagtgtaagtcaccatttagtccactctcactcaaccaaataagccacagttagaaccatagctgtctccagcacactgaatccagagagtctagtaagtgcattcacattgatggatgcagatggaactacaactgcttctgcctcctgtgcacattcttctggcaagttatctggtggcttcttgctcctgcaacccacctcctccaggaaatgttccctgagtcattgccagcacagtgacaagctccccagagaggcagcccactcgtgagcccagctcacttatctcatcttcctgcgttggggaggaaactgcctccagagaccggaattcctggggcctgcagggatacccccgatgctgcagggggagggacggagctcccaggccccttcctaccagaacgttctacaacccccatataaattcttagaacccagagttccacggagcatgaaacagtcatctgctttcactttcatgttattgaaatcatgtgacatcacaaggtcacagggctggaccaagaagggaacaagacttggatctccttccaaggtgtgcaagagggccatgttgtaacatattaacagtatctttcataaaagaggggagacagccagtggtgatgaagagagattttttttttaagttttcaattaaggaacttgaaattctgaacatttacatgtgaaattcagctgcagcatatctggatataaataatacattgaaatttatgtagttaagctttacaggagtcggacaagctctgaaaggatttgcatttcattccgttttttaaaaaatgtgttaactaaaaataaaataatttcaggcatataaagtaactaagtcagtaaggagaatttgcaatagaaaatgagtcacatttaattcagtgcctgtgtcttaaaccattcatgggattaatttacaggataaagtcaccctgggggtgggagagggaggaggctgctctgaattataagccaggacattggttctggcctccggattggttccatcttattcttccctgctcttcttagaactagctctcctttttgtttaaacaatgcctggtaaatatttctgcagctggagaggtcgcaggtgtggcaaagaaggacaggaggtgagaggagaggaatagatggggagacccataggctgggctctctccacattcatcttttccttgatccatcgcttagggctgcttttctcctgagtgttcaattccgagcaggcattcaacagccttttggtgattatatgagtctcctgagaggctataacaaagcatgacaaactgggggcttcaacgaaggaaaatttatttgttacagttctggaggccgaattccaagagcaaggtgcaagctgattcagtgcctggtgagggtctgtttcctggttcatagatggccccttcttactgtgtcttcccatgacagaaggggctaggtaggctctctagggtctctttttaaagagcactaatcccagtcatgacctgatcacttcccaaaggccgctaatacaatcactttgggggttaactttcaacatatgaattttgagttgggggcacagacgttcagaccatggcagtaggttttcagttctcctgagactgtgctgaagagtggaatttctgggttgtatggtaactctgtggttcatgttttgaggaaccactcctttttttttttctcatttaacatgtaaggaaatggaggcttggatagtttaggtcaactggcaaatgcagctagtaagccaaactgctgggagtccaggccagcagttttcacccggaccccgtgcacggaactcctccatcacactgacttgccgtgcatccggaaggactggaagttattttggtgaatgggggcaggaaggactcctgggaagatgtgttacatcctagaagtatgggaggactttttgcatttatgtgggaggagaacaactagaccatgcattttgtgggatgaactgacagaacagaggttgaaggagctgttccttgaagggccttgcataccatgctcaggaattgaatgcagaaagattttaagcagaagcgtaagtatgaaaaatatatgcatgtaaaagaaaaatgaaacccaacctcatatgaaaaggcaaacacagaggaaaaaatatttgcagccacatgacattgggttaatagctttgttatataaaggactcttaaaactgatgatgaaaacatttaaacctaactagataaatgggcaaaggacatgaacagatgattcacaaaataagaaatgcaaagcagtaaacaaacatatggaaacatgttcaacttctagtataatcaaagacatgcaaatttaaacaacagtaagggaagcaattctttgcctatcagattagcaaatgtttgtcaaaatgataatagtcgattctggcaagagggagctataagagaggaattcccgcgcatccttggtatgttcaaatcccggatgccaaatgctcccttcctcgtagctctgtaattctgatctggcaattagttccctcagaagctccatctacatactgtttacaataaagacaaaaattagaaacaagaaggcagagggtgtaggagaccaaagttcagcgcatcatctacatgtgaacgtcaggggggtcactctagccctgacatctcaaggagctccagaactatgcaagtaaaactttattgttttatccaaacttgctttgccacactgattttttctttctttccaacttttagtttaggttcaaggggtacaagtgcaggtttgttatgtggataaattgcatggagtggggatttggtatacagatcattttattaccccgatactcagcataatacccgataggtagtttttctatcctcaccctcctcccaccctccacccccaaataggccctggagtctgtttctccttctttatgtccatggatactcagtgtttagctccacttataagtgagagcatgtggtatttggatttctcttcctgcattaattcacttaagataatggcctccagctccatccatgttgctgcaaaggacgtgattttattcttttttttttgtggctgtgtagtattccgaagaccactcccattcttaagtttccttaacagtatcactggctgaattgtaatccatttctctcctcctcttttccttcatttaatctattcccctcaaattttatagttataccccagaaagccccttgaatctgttctctcaccttctttctaattgccattgctttaaaccatcccttattttctcactcctcaattatttccagagcctcctctcacaggctgtatctcctgtctcctgtcccagggggtatggagtgagaaggaaggggaagtatcaaggaagagacacaataaggccttcaacagtatctgtatgcttttatttcttatttttagaatatctgaagcaaatatcccaaaagggtaggatttattgaatctattatattaaccagatattcagtacattctctaaatttggagtatttaataacaaaatgtttcgcatctcttgtctgatctcctatttggaaattcccctttattctctttcttctttcacaattcctttaaatattttaataataagtaaatctgattatgtcacccttgacttgaaaatttccattagcttagctttctgtttcttacagaataaaatccaaactcattagcttgacacaacgggctcttcataccctatacccaagccatgctacactttatagttccccaaaccctaacctaaatgactctagcccctaccccgcacctctgcacataccctgcctagcacatccactctccagctccccatctggcagctcgcaacccacttttcaaagtcaaggtcaagcatctcttccagaagaaagctttctctgatgttctcaaagcagagtttggtcattcctttctttagcttctcaaaaatattttgttcatgacatttatcattgcttttaccacactgctttgaaatttgtcttcattgtttcctgtaataacagattgtgagttctgcaaggacagggctggtgtcctattcatcttgcaaatcccaggctgagtgcagtgccaagaacattgggagccctgtgagtgccattagaatggaggaaagaggagaagcagagagtccgtgtgcaccagaacaggtttttccctcctcaatggaaataagagtgcagaccaaagtttgtgtagactcagtttggatggcaggtagagccaagccagtgaacagagagtactgttggaagagaacctattccaatggcagaaggcaggatggaaatgttgaaagtttgagggcattctgtgagggcagacgtgcatcctggaccaatcaggcatacccctggccttcagtgatacagaaaatgtggtggcttgatgctcagatctgctttagatttgaggcatctgttcccttagctgcagggagtgtggcaaccaaccactcttggttgagtagctttgtaggacttgccctcagcccaagaaagccacctcatctaagttcatgccccttcctgaggtcaatgactgggctggccaatgagggatgcaaaggtccagcctgcttgcctccaggctgggcaactaagggtaactctagcaccagagctccacatgggatcatttgaggcttttttgtttctgcaacaaagttcaccttttccccttacccatttctgctttcttcactgtcaaacaggtgctaattcctaagtcactctttaataaacttctggcatgaaaatctccatctcagtctgtttcccagagaactgacctaagacaagtgatgttgcaagcgtttatgtttctattccaatctttttactacgttggaaaatgcttccttatacacagctaccaacattcgctccccaaatttttgaagttttttttttaatcattttgttattggtccgaaggttactgaccaatgatcccacctcctcttcttaagacctgagtaaatgttttcttgtttttgtttttgtaaagattgctaaagtgtcacttatttacttacttgagttgcattatatttcatcatatagaggtttgaaattaaaacaaattggcattgaactaggaaggtatagacaacttcgatatttggttcccctctctattagctaaattgttagggaaaaaaccttttaaaacttcttagaatactccaattttaaaggaaaaataactttgaccagacatatttttattcccagtgagttgactttgagggatgaaggcctgtctatatgagctgagtgataggctgtggtttgagggagctggctataaagtatgtttgagatttttaattcgtgggttggaatgccaattgtttatttggaacagcaaaggctgagatggtcaaacatccaaacatggtggtatgtgcccttgaatggcccgtttcaacaacgggctttgctttgaggatgtgtgtggctatggtgttgcattggaaagaagatagaatttgtgggaggaaactttggaaagctgtcagaaaatgagaccctccttcctcccttttctctttagaatgaactttagtccatttttctcaatcctgcctgggactttgtcctcatttttgagccccaatccaacagggtcccttctctccagcagtctctacagttctgctccttcacccatatcctattcatgtcatggcagattttctatgtgttctgcaacagattgtttcatagaattgttttttagtatttgtgaattcatttggaatgcagacattgcaatcatgggtaagattgactattaggagaaatactctctcctcccctcccttggagcaattgaatagcatgccacacatcagatcaaacgaacaggctttagcttcattggtaaacagtttacactgcagagctactgccatcttgccaaatcgcctaagaattagatatggattccagctcaccttgctaattaattcagaatgagaagatattccaaaaagcaacattcttttataccggtggagagtcacacagacatttaaaaatgcttgaaaactggggtgggtggaatatctatcctgcctgttatttttagcttaagaagatttctttgccaaagtctgtttccaaaattttatcactttctgagaaaaatagtgtgcataaaagcatttgggtattatggctgactgattcatctttgaaacaccagcacctagcatagttctgggcatattgtaaacatttggttgttatggtattgaattaaatcctaatgtgcttcaatagtgtggtagccaattcaggaattcacggggataactgagatgaatttcagtacatttccaagtaatgcttattccatgtgcttttgtaaccaactctctaggaatggaacttacctaaggccccattgttagtaggcaggggacctaggggaccagattttgaatttagtactggttgattccacagtttgcaatgtctccttctcgtcctgctggagaatctgttttcaagatctcttgtcagttttgtttggtcttaggtatacgtatgttcttgctgtttgaaacacttatgcctgtattcagagcccctagtcagacatccagtgatttcacccttcctggactgtaatgagaatgggaaaagagggtatgatcaatagacttttattaaaatgctaccttcatgagggtgtttgcattttaaatgggaacctggaaaagtagagttttaagttactaaaaaatgtacactcaacagcctgagggatcttttagaaatatacataaagtcatgtcatttcctgtcttaaaatctcccagttggcctcttactgtacacagaagcatgtaccaagttctgtaccatggcctgcaaggccccacatgatctggcctctgcccacctccctggtcctatatcatcccacttgcaccttgattctaaactttctggttccctgaaaacactgagctcattcacaactcaaaccctctacaactcactgatctctctgcctggaatactcctccctcagatatttttcatgtctgctttctaatttttcaggtctccttagataagctttccttttttgcccaatccaaaggtgcctgcctccacccaatacccagtcactgtttctccttatggtcctcttctaatttctttatggtacttattgctgtctcatttgtttgtgtgttgtctgtctcttccatcaggatgtaaattccctgattgcagggacctcatctgccttgttcactgcctgtatcctccatgcccagaatagtgccaggcactattttccttattatatttctgaaaaatgaacgaatgtcttcaaaggtgaaattcaggctttgtaggagtagaatggaggagaaaggggctttagaggtcagaaaacatctctggaggcatccagttccctcgccccatctctagatgggcttgcctctggttctgaaccttattgctgacctggagctgtgattggagtctgggagctgatctatgtgggtggctgttgcctgcaaagtgcttggcagggagcagagggagaggttcagtgggtgggaggttgtacaatgccagtggctgcattgtgctttagagccctttattatgtcaggtacatgtgaagcaaggaactacattttggtgaggatttagagtttgaggatgcaggaagggtagttctgcttctgttgagaggttaaagttcctttcatgtgtcctctcctctctgattatgaagcttccagtgaaccatgtgcgtggagagcactgggcaatagcagaaaagtaccggctgtcccctattttctccagaggtaaaagaagcagatatttatggagggaagaaaggagaattttagtaattaattggattgactaatcactctgcagctattttaacgaaataagttcttgagctaactgacacacttaaaagctggtttaaaacgttgtttgcctttcttcctttaaaatttttttaaatttctgtggatcatagtaggtgtatatatttatggggtacatgagctattctgatacacgcttccaatgcataataattatgtcatggtaagtggggtatctatcttaaacatttatcctttgtgttatagacaatccaattatactattttagttattttaaactatgtaattactaatgactatagtcacattgttgtactatcaaataataggtcttattcattctttctattttttgtacccattaaccattcctcactcccatgacaacccacctcccacccccactacctttcccagcccctggtcatagcaacggggctgtcttgctgtccgtggtgctgaaacaaattttctttccacgagtgcctgaatggaaataacatttctgtggttttccacttctttcacactacagggaaatttatgggtttcaaactcttttcacacatatcttatgcctttttcctgagagttctctagactatgtagggaaggcagttccctttcccctcacattatggattaaaaatctttggcttgaatctaaaaatctctagtcttatcggaatttctctcatttccatggatgtcttgtaaaacaaatatttttaatatatgcaagcaaagttaattgtgggaatttttcagaaatgcagataaacaaaaaataaaatgaaaatatggccccacacccatagagaactactaacattttggtaaacatcccttgatatagatagatagatagattaatagaagatatatgatataatcctgcatatattgtctttacagttgttatatcagccttttattttttctaaatacagtacaattttataaaccatagtcttcatgttgtacattaactctctagacgtgttcatcctacatgtctgctactttgtatccttcaacttacattttcccatttcctccctgctaccagctctcggaaaccacagttttatctcaatctttatatatttgacttttaaaaagattcctcacataagtgagatcatgcaatatttttcttctgtgcctggtttattttacttagcatgatatcttccaggtccattcatgttgtggcaaatggcaggatctctttttatgaggctgaataatattgtattgtttgtctatatgcactgtgtgtgtatatgtgtgagtgtttatttttacttatatctcacattttctttatccattcattcattgatgaacatttaggttttttcatatcgtggctactgtgaataacactttaatgaacatgagactgcagatatcttaatgaggtggcgatttcatctcatttgggtatatggccagaagataaattgctgagccatatggtagttctaattttaatttccttaggaacttccatacttttttccataatggctgtgcaaatctgcatttctatcaacagtgtactagggtccccttttactccactgtcaccaatatttgttggttcttgcctttttgagaataaccatcccaatgggtgtgaggtaatatctcatggtgtttttaatttgcatttacctgatgattagtgatgctgagcaccttttcatatacctgttggtcatttgtatgtcttctttggagaaatgtctgtttaggtcctttgcttattttttaatttggatatttcttttactgctattgagttgtaagaattcttactaaattttggatattaacccctgatcagatatgtgggtggcaaattttttttccagttcataggttgcattttcattttgttgattgcttccttcacggtggagaatctttttcgtttgatatagtatcatttatttatttttccttttgtagcctgagctttggtgtgataccccaaaaatcatttccaagaacaacatcaatgagctttccccttatgctctcttttaggagttttatagattcaggtgttgcatttaggtcttttattcactttttgttaatttttgttagtggtatatgataagggtccaattttgttattttgcatgtggaagtcaagttttcccagcaccatttattgaagagactatcctttccccattgtgtccttttggtgcccttgtcaaaaattagtggaccatatatgttcggatttatttctgggttctctattctgttccattagtctatgtttctgtttttgtgccggtaccgtactgtttaagttgctatagctttgtaatataattttaagtcaggaagtgtgttgtctccaagtttgtttttctttctcagaattgctttggctattcatggttttctgttattctctttgaattttagaatgtttttgtctctttctataaagaatgccattggaattttaataaggtttgcattaaatctgtatattgctttgggtagtatggacactttaacaacattaattctttcaatccatgagcgtgggatacccttcattttaatcaaggttttaaagttttcagtgtacatatctttcacctccttgattaaatttattcttatcttttttgatgctatcataaatgggattattttcttgatttctttttagctaggttattatttgtgtatagaaatgttactgatgtatgcagtttgatttttatatcctgcaactttactgaattaacttattagttctaacagttgttttgtaaaatatctggggctttctacatataagaccatgtcatctgcaaatagagataatttcacttcttttgttctgatttgggtgtcttttttttttttcttttctgattgctcttgctagtacttccagttctatgttgaatagaaatggtgagagtgggcatctctgccttgtactgaatctcagtgagaacgctttcagttgttccctgttgattatgatgttagctgtaggtttttaataaaacacctctattccgttgaaggacttttcttctatacctaaactgttaagagtttttatcaagaaaggatgctggactttgtcaatgcttttcctgcatcagttgagatgatcaaaatttttatttttcattctgttaatgtgatgtattacattgattgatttgaatatgttaaaccagccttgcatgctagagatttatcccacttggttgtgatgtaaaatcttattgacatgttgttgaattcagtttgctaatattttactgaggattttggcatcaatattcatcagagatattggcctgtagttatctcagagatattgacctgtagttttattttcttgtaatacctttgtccagcttaggtatcaagatgacacttgccttgtaaaatgtgtttggaagtattctccagctctatttcttttttgcaagactttaattagtattgataataattcttctttagatgtttggtagattcagctgtgaagctgtattagttcattctcacactgctataaagaactacctaaaactgtgtaatttttttttaaaaaagggaggtttaatcagctcatggttatgtgggctatacaggcttctgctactggtgaggcctcaggaaacatacaatcatggtggaaggtgaaggggaagcaagcacatcttcatatggcagcaggagagagaaggggaggtgcgacacacttttaaacaaagagatttcaagagaattctatcacaagagcagcaaggggaaagtctctccccatgattcagtcacctcccaccaagcccctcctctaacattgaggattacaattagacatgagatttggatggggacacagaggcaaaccatatcattctgcccctggcttttcccaaatctcatgtccttctcacatgtcaaaacacaatcatgccttccaaacagtttcccaaagtcttcacttattccaacattaactcaaaagttgaaggtccaaagtctcatctgagacaaggcaagttccttcctcctataagcctgtaaaataaaaaacaagttagttacttccaagatacaatggggctacagacattgggtaaatgctcccattccaaaagggagaaattggccaaaacacaggggctacaggctccatgcaagtccaaaacccagcagtcattacatcttaaagccataaaatattcttcttttgactccatgtcttacatccaggccacactgacacaagaggtgggctcccaaggccttgggaagctctgcctccatggctctacagggtatagcccctatggctgattttacaggttggtgatgagtgcctgtggcttttccaggaagatggtacaagctgtcagtggatctaccattctggggtctggaggccggtggccctcttctcacagctccactaggcagtgctccaatgggatctctgagtgggggctccaaccccacatttcccctctgcactgccctagtagaggttttccaggagggctctgcccctacagcagacttctgcctggacatccaagcatttctgtacatcctctgaaatgtaggtggaggctcccaagcctcaactcctgccctctatgcacccacaggcttaacaccacgtggaagtcaccaaggcttgctgattgcaccttttggagcagtggcctgaggtgtatctgggccctcttagccatggctgcagctggagtggctgggattcaggatgtcatgtcctgaggcttcacagagcagcaggaccctgggccttacccacaaaaccatttctgcctcccaggtcttcaggcctgtggtgggaggggctacagctaaggtctctgaaggcactttccccattgtcttgtctattaactttcagctcctgttatgcaaatttctgcaaccttctggatttcctccttggaaaatgagtttttcttttctaccacatgatcatgctgcaaatttttcaaacttttatgctcttcttcccttttaaatataaattccaatttcaggtcatttctttgtttatgcagatgcgtgtaggcttttagaagcagccaggtcacatcttgaattattttctgcttagagatttcttctgccagataccctaaatcatcactttcatgttcaaagttccagatctctagagcaggggcctaaagctgcttgtcttttcactgaggcatagcaagagtgacctttaccccagttcccaaaaagcttctcatctccatctgagaccacaatgtgtccatatcattatcagcattttggacacaactatttagcaagtctctaggaagttccaaactttccctcatcttcctgtcttcttttgagccctccaaactgttacaacctctgcccattacccagttccaaagttgtttccacatttttaggtatctttatagcaataccccactcttggtaccagcttttttgtgtgagtttattctcacactgctataaagaactacctgaaactgggtaattttttttttttaaagaagagttttaattggctcatggttctgtgggctgtataggtttccacttctgggaaagcctcaggaaacataaagtcatggcagaaggtgaaaggaaagcaaacacatcttcacatgatgacaggagggcaggggtggtgctacacacttttaaacaagcagatctggggagaactctatcagaagaacaccaagggggaagttctctcccatgattaaatcacctcccaccaggtttctcctccaacattgaggattacaattcaacatgagatttgggtggggacacagagccaaacaatatcagaagccatctggtcctgggcttttctttattgttactagtctgttctggttttctgtttcttcctaactcaatctcagtaagttataatttcccaggaatttatccatttctcaagtttatccaatttattggcatataattgttcataatagtcatttatgatccattttatttattaagtgagtgttgtaatgtctccactttcatttcttgagtcttatctctctctcttttagttagtctagcttctagaagttttccatttatttatttagagacagagtctcactctgtcacccaggctggagtgcagtggtgcaatcttggctcactgcaacctccgcctcccaggttcaagtgattctccttcctcagcctcctgagtagctagtattacaggtgcatgccaccacacctggctaattttttgtatttaaagtagagatggggtttcactgtgttagccagtctggtctcgatctcctgatgccatggtccacccacctcggcctcccaaaatgctgggattacaggcaagagccaccatacctggttgaattttgtttattttttcaaaaaaccaacttgtggtttcattattctttcctataggttttctgttctctatttgatttattctcttctgatctttattatttccttccttctactagctagtttattttgtctttttttttttatttccttgagatacagtgttaggctattcatttggaatctttctttttagtggaggcatttatttttctaaacttcccacttagaatgcttttactggccaggcgcagtggctcatgcctgtaaacccaacactttgggagcctaaggtaggaggctcacttaaggtcaagagtgtgagactagcctggacaacattgcaagatcccctctctaaaaaaattgaaaaattagctgggtgtggtggcacatgcctttagtcctagttactcagggggctgaggcaggaggatcacttgaacccaggaagttgtggctgcagtgatccatcagtgaatcatgatcacatcaccgcactccagcccaggttacaaagtaagaccccctctaaagaaaaaaaaaattgattttgctgagtcttataggtttttggtgtattgtgtttctattttcatttgtctcaagtttttttttcattttgatttattctttgacccattggttgttcagaaagatattgtttaatttttacatatttgcaaaatttccaagatttctcctgttattaatttctagtttcatactattgtgatcagaaacaatagtagatataatgttaatcttcgtgaacatgtttagacttgttatgtgtcctatatatggtctatcctggaaaacattccatgtgcactacagaatatgtatttttctggtattaggtggaaaatgatatatatgtctgttaggtccatttggtctaaagtgcagttcaagtccagtattttctcattaattttctgtttgttgatctattcattgttgaaagtgggatattaaattttcctactattattgcattctatttattccttcatgtcattaattttgctttatttatttgggtactttcatattggatgcatacatatttctaatttttctgtgctcctgaataattgactccgctatcattaaataatgaccttctttatttctagtagtagttttgacttgcaatccattttacttgatattaagtataactacctttgctctcttttggttattatttgcatggaatatctgcatcccttcatttttagcctatgtttgtccttgaagctaaaataggtctcttgtatgcagcatatgattggatctttaaaaaaatctgtgcagccactttatgtcttaagagtttaaacaatttacatttaaggttattattgataggtaaggacttatacctgctattttgttgtcttatggttgttttgtagctcctttgttcctttcttcctctcttgttgtctacctttgtgatttggtgattttcttatagtgctaagttttaattcctttctctttcttgtttgtgtatctgctgtagtttatgctttgtggtgaccatggggcttacataaaactttttacagttgtaatagactatttaagctgaaaacaacttaacttcagtcacataaaaatactctagacttttacgtctgccccaaaatttatatttttattgttacagtttacatctttttatatcgtgtattccttagcaacttattgtagccgtatttattcttttgccattttgatttttaacttttatactacagatttgaaagatttacacaccaccattgaagtaatgaagtattctgaatttgacaatgaatttacctctaccaatgagttttatagttttatatattttcatgatagtattgtcctttcatttctagttgaagaattccttcccttaagaatttcttatagggcaggtttagtggtaataaattttctctctttttgcttgtctggtaaagactttagttctctttcatttctgaagaacagctttgctgggtagagtattctcggctgacagtcttttttattttcaggatttcactacgccatcccattctctcctggcctacaaggtttctgctaagaaagccattgatagtctaactgggattatcttgtgtcacttgacactttactcttcttgcttttaaaattctctttgtctttggcttttgacattttgattataatgtacctcagtgaggacctctttgggttgaatctgttcccaacctttgagttttatgcatatgaatgtccatatctctcccaagactttgtagttttcagtaactatttcattaaataagctttctgtgcctttctctatctcttctctcttccataatatcactatttgtttgctttatgctgttgcatagatcctgtaagttttcttcactctttttcattcttttttttttttcctctgactgggttatttcaaaagacgtgtcttcaagttcagagattgtttcttgttcttaacctatctgttgttgaagctgccaattgtatttttatttcattcattgaattcttctgctccaagatttatatttggttctttttatgatgtcaatctctttgttgaatttcttgcttaggtcatgaattgtttttctgattttattgaattgcctactgtattcttttgtatctcagtgtatttccttaagatcattatgatgagttccttttcaagcaatttgtaaattttcgttttttggagggtgggtcaattattggataattattgtgttccttttgtggtatcatatgtccttgctttttcatgttttctatgtccctgcattaatgtctgcacatctggtggagctgttacatcttctagactttacagagaaaactctcatgaggaaataatttcacctgccaatgggtctagggtgacagttgggaaggatgtagtggatctgtttctaagcgaatgcagtggcttagcttctgtacaggttcttcatctgagatcaattttggtgatgactgtgggtatctcagtggcctagattgcaggagtttatggctgaagggatcccctatggtgtcagttcagttatggctcataggcagccacagtggttctggggtccagggtgcaggttcccagagcagctatagagtggaggttctagactcaggatctcaccactctactatggtgtctggtacttcaggtgcaaggtcactgtctcaggcatgagtagatgcaggctgatcacagaactagagtctgtgactctgaggcacactccagccacttggacttaaggagctaggttgtagccgtgactctaacccagctctggggaagaagaggtgctctacagtttcaggctccagggagcaaggcacagcagcaattcaggaatcagagtcagtagggcacagtggaaactcaggccttgcgggatgaggcaccacatagtggtggctctggaccctgggatggtgggacgggacacagcagtatctcaggctctgtaaggctaagtgcagtggcagtaagaatccaggaatgctgtggcacagctgtagcctgggtcctgaggggcagggaacagtacagcaatgattccaccacccagggaggtgggatgcctcaacagctcagaccctgggggctagtccagttccagggaatcagggtactatcgttgcttggcctggagggtgaggtgtcccagctcagttggtgctctgtttccctgggacacagagtgccacattggcccagctctgagaggtgcagctactcacctcagccaagacactgataaactcatgaagcagggcactatttcagctctgatgccaaggggtgtgactgctgtgggaggcaaaggcactgtttccctagggggtgggtgctgtttcagcacaggtgtcaaaagggcagggtgcagcagtgactgggatgggaagggcacagctgtctggcttgacttgtatatggtgagccaccaggcagggatgttcagtggtgacaaaccctccgaaatggaagggtgtaatagctacttgcccctggagcagagcacactccagcaatggttctggttccagaatggtgcagagcagtagccacgtgggccaggaggggaggagaacaccattagttacttctctgggagaagcacagctatgtggactccagacagctcctttagctgggcacctgtgaggactacaggagtcatcaatggtgaagactgtgaccagggtggtgatgggggatgctgggttccttttgcttaccttttcccctcaggttccaactggtcctgactggggaataggatggcagaggtaagtgtttgcttcactttgctatactgccttcctgggtgtgcatctgctacaagacttctgctattcctttgctgtactttggtactcttctttagttattttcatcaaaatacagttgtttattcattgctttggatgtcttgtaggggggatgagtgcaaagggctatcttgctgacatcactcttcatttatattatttacaacaagtttttcactgagaaatttattaggtacttttccctgtgttaataaacatagttcttcaacacttcaacataggaagagtatataattgtgggtttataccatgatttatggccattattttttgttggacatttagatcatttctgttgtctttgcaataagcgatactgtaatgaaaactcttgtagctaaatgtttatgcatgttcttatttatttcttcaagataactcttagaattagaactgctgggtcacacaatttaaggcctttaatccaagttgctaaatagcccaatttgcactcccaccagcagcccatttttctctacactcatacacactgagtattattatttaaaaacatacttttcttcattttgtgggtgaaaaggcatcttgctgatttaatttgcctttcttatattactagtgagattggattttttcaagcatttttttgtcatttaaatattttgtaacttccttctcataatctcctattttcctgtttgagagttttaaaatccagatcttctaactctaaagtcaatgctgtttccttgaactcccaagggacatctgatatgaaaataaataggtgtccaagactggtccttagggtgtaacatggttctcacctttcaggatccttctccttcagatgccgccataatgtctgtgtttctttgttaccaacatatcacctcattcaattcttacaagtgttttgagaggcagatggggtaaaccatggtgtctgtacaacagggaacggaggcacattgaggctaatggatttggccaagatcacaaactattgcataagccaaggtgagccttgaaaaaggttctctcaggggtctagtgggaaaattatctgataagctaatcacacttctgtttaatgactctcataatgtattatcttttccagagttatttgcatttaaatagaggaacctgaggcgatctctatttaatgtgctccatcaagccggggaggagctatattaggatctggagcccgcccaccccttaaatcacagtgtgggtgcccacctacttcatctatgcgtggtcctcacacttctcaacatgagttgcttgaaacaccgactttgatgatctgaatatacacaatgtgaggccaaaaactgaaagaaaatagaggcagctctctctctctcatttttttctctctctctccttatctctatctctccatttttaaacagtcttctatgctctgaaaactgtttatccatgttcttcacaaattattcagaaccactcttctcttttctctgaggttagcaagttagtaagtagctctcagaaatgatctctatgcacctggaacaataagcagctggcttaaaagtcataggactctgagcagagatagctcctctcaccgactcactgtctgatgaattcaggcttctgtttgtcacagctccccagtgaccttttgtggcagatctactatagactcacagtggacaccaggcctcctcatcatagcaggtgaggatgacctgatcaccacttctctggtgctctttctgcatggtgacgtttcacatagtacaaaatcacaaagatgcatgaagacattatcagggcatgtttctccctcaccttagatgctggccttccactgacaccactgccttaggtttctccttggtaagattcacctgcaatgacttcaaatgttttatgaaagaggcatctttgcaattttttggtgatatttttatagaatttttttgtaatattttactcatgttcttttaataatgattgaagaaaattgcttatttcaatgaccatctagtgccctgcccatattccctctatctctgtaccacttttttgagggattttctaaaggtctttgttggtactttaattttttgtcaattgacacactcatgttaagaatcctgaggcttggatacaaaatcaatatgcaaaaatcactagcattcctatacatcaacaacaggcaagccaaaagccaaatcacaaatgaactcccattcgcaattgccacaaaaagaataaaatacctaggaatacagctaacaagggaagtgaaggacctcttcaaggagaactacaaaccactgctcaaggaaatgagagaggacacaaacaaatggaaaaacattccatgctcatggataggaagaatcaatatcatgaaaatggccatactgcccaatgcattttatagattccatgctattcccattaaactaccattgacgttcttcacagaattagaaaaactatttaaaaattcatatggaacaaaaaaacccgaatggccaaaggcaattctttatttttatttatttatttatttttgagatagagtctccctctatcaccccagctggagtggagaggcctgatcttggctcactgcaacgtctgcctcctgggttcaagtgattctcctgcctcagcctccccaggtagctggggctacaagcatgcaccaccacatgcctgcccagacaaaggcaattctaagagaaaacacacacacacacacacacacacacacacacacacacacacacacaaccaaagcaaagctggaagcatcatgctacccaacttcaaattatattacagggctacagtaaccaaaacaacatggtactggtacaagaacaggcataaagacccatggaacaaaatagagaatgcagaaataagatttcacacctacagccatctgatctttgacaaaccttacaaaaacaagcaatgtgggaaaggattccctatttaataaatggtgctgggaaaactgcctagccatatgcagaaaattgaaactggaccccttccttacaccttgtacaaaaatcgactcaagatgacttaaagacttaaatgtaaaacccaaaactataaaaaccctagaagaaaacctaagcaataccattcaggacataggcacaggaaaagattttgtgacaaagatgccaaaagcaattgcaacaagagcaaaaatagacaaataggatctaattaagctaaagagcttctggacagcaaaagaaactatcaacagaataaacagacgacctacagaatgggagaaaatttctgcaatctatgcatctgacaaaggtctaatatccagcatctataagaaacttaaacaaatttacaagaaacaaacaaccccattacaaagtgggcaaaggacatgaacagacacttctcaaaagaagacattcatgtggccaagaaacatatgaaaaaaggttcaacattactgatcattagaaaaatgcaaatccaaactacagtgagataccatctcacacaagtcagaatggctgttattaaaaagtcaaaaaaacaacagatgctggcgaggttgtggagaaaaaggaatgcttttacgctgttggtgggaaagtaaattagttcaaccactgtaaaagacagtgtggcaattcctcaaagacctagaggcagaaatgccattagacccagcaatcctatcactgtgtatatacccaaaggaatataaagctttctattataaagacatatgcatgtgtatgtttattgcagcactattcacaatagcaaagatatggaatcaacctaaatgcccatcaatgataggctggataaagaaaatgtggtacatatacactgtggaatgctatgcagccatggaaaggaatgagatcatgtccttttcagggacatggatggagctggaggtcattatcctcagcaaactaaagcaagaatagaaaactatatactgcatgttctcacttctaagtggaggctaaatgatgagaacacatggacaaattgtgggggtgggtgtggaacaacacacaatggggcctgtcggaggctgggggaaggtaagaggagggagaggatcaggaagaataattagtggacactaggcttaatacctaggtgatgggatgatctgtgcagcaaaccaccatagcacacatttacttatgtaacaaacctgcacatcctgcacatgtacccctgaacttaaaataaaagttagaaataaattaaaacaaaaagaatcctgagccttgaggtagactgataacattatgagttttttcttcttgtgaagttgtgaggattgacacacagttactcaaaattggctgatgattgcaggaaggaagggggtcactgatccatactttgattattaatgcagttaacttttttaatccagtgatggagtaaccatggtcaaggtaaggaagggctaggagtggtctcacatctccagggtaaataatcaggtggcagataatcactactaattgacacctctcgtgtgtgtgtgtgtgtgtgtgtgtgtgtgtgtaacaggaggtcatactatctgtataagtttgctgactcatcttgcagcttttcatgatctacagtttttttcttctccatcaaatggtgatgataatctctgccacataaacctaataggtgaaagtcaagtttaacatggaaggactttgagaagcagataatgctacacaaatgcaaagagattttatttcctgctgtttattggagtggatgggctcctacagggatccagagcacatggctagcaggtctgctggagctggataactgacacatcaggtgtagagctgtgaggccccatcctgaagcatctacacctttgaagaagacatttcaaaagctagaatgacaggtgcctgagaattgatttttaaaacacagctcttttcaagcaagaaaggggcccacataatttgtttcagagaaagacatgtcctagctacaagagtcaactcctctgggtatcttgggatatttcacattcatgggcatgggggttagatctgcccaggtgagtgggcagggcatggtaggcagatgttcctgctggagccagaaccatactttcttcttattttgtcagaaacaatgtgttattttggtaactctttattttccacactgtagcttcccatgtaattattgattgcaattaggtattccatactgcataattaactatctgtgcctctgacatatattaaaataaatgatcacaaaagtccatgctgaaaagcctccatccaaagaataaacccaggctttctacctacctgacagtgtgtctgaatcaggcaaaaaacaaatttaaacatcttggttccttctccatctgctatacacatgaatgaaatttaacattagcaagcagagcaaactggctttgttgacttttctttgtcattttaagctacggtttttttattctggtttacgcagatatctaaataaaacctctctatagcatgaaaaaagaagtgatggatggatcagtgtccaaggatgatccataaatccaacttaactaaccagtgcacaaggtagctgcaaggtcttgctttctctctacatcaaatttattcttgtgcccagagggaaaaaactagcaaggcatactcgagtgagagctttgcattttatacacatctatattaaccaggatacttttgattgcaagtgacagaaacccaattccaagcagcttaagcaaagatgggaatttattggtaagttactggggtatctcagagaacaaaaatgagctgcaggattgtgtgaagctcagagaccagaactggcaacttgatgacaccaaggatctatatgtctctattcatctctcgtccttggttttctccctgtcttggcttcattctcttgtacagcagacacgtcttctctatgtggctgtgatcactgctgccggaaactctgggatctcatttctgtagcttttgtcaaaggaaaaggagtgtctttcatgttagttctgttaagaaaaacaacagtgaaattctgtgagtgacctagatcgggtcaagtacccctatcaccccagaactgttgctggcttgaggagtagggaaaggtacttgattggtccagcctgggtcatatactctgccctgtgcagggaaaaaggtttgtgaccagaagaaggtgacagtgggacaggggaagcatgctgcgtaggtggcagcggtagctctggagaaaccatacatgataggatgcacatttgaggagcatctccagggcctgagagaataacccaaagtatagagaagcgagactattctgtataaaaccttagaattttgttttccattcttggaacttgtgttttctctcatgaccaggactctttattctccagtgaggctatgtagaaatgcataaaaatttcttgtcaaattattttctgaagaaacccagtatcaaaatcccagatatggtggcaaggagtggtgatagtgaggatagtcaaagcctttgggagatgggggtgagtgctgatgccttcttggcttcaagtcaagcaaggcagccatggaagaaagaacgttggttatcttagatatctcagtcataggaaggtccatgtcttatcttcctcttgtttcacttaaagattgaagattgtttgttttgttttgttttgttttgttttgttttgttttgtttttagagacagagtcttgccctgtcatccagagtggagtgcagtggcaggatgaaagctcactgcagccttgaactcctgggctcaagtgatcctcccacctcagtgtcctgagtagttaggattacaggtgcacacaaatgtactcatctaatttatttaaaaaaattgcagagacaggggttttgctgtgttgcccaggctagtcttgaactcctggcttcaagtgatcctacccccttggcctcccaaaggattgggattacaggtgtgactcactgtgcctggccactaagatcatttttgaaaaggaattttatctctttctgtagatagatagatagatagatagatagatagatagatagatagacagacagacagacagacagacaaaagtgaatgctcaatgataatgccccaaataaatgcccaacagtcatcacaaacccaacatagcaacataggactctgggtgtttctattggactataaattaattgtcacattgtctgatctgattcatgggtcttcccaatgtcttagcttagtatccacagaaagcaaggcctgaggcgaagctcatgtgttacctctttattagggagtaaaatcgcagggacaaggggagtgagccagagaaggagggagagctgtgataagttggcaactacttggtaagggtaactggttgctctattgcatggggccatcttcttcaagaccaaataaaaagataatccttagcgtagtccatctgattgagtaagggaagagagtttctgccagatacccatctctcattggcctaacctttgacctacagggcatgaatggcctagtactttgtagcctgggtgttcatgcctcagtgtcaaatgagggtgtcccaggataagaagctagtggtgggtgctgcaggcccaaggcaaaccagtgtcgggtcatgtgcctgtgaggctggggttgagttgggctgagctgctcatcacagtgctggctggggctgaacaagtgactcaaggccccgagacaggtgagagcaagaggacagaagggacgtgtggaaaacacctgtttccttcagaatcagaatttcaaacctaagagagacctttgagatacttttcagataagcaaattaaaacccagagagtgtaagaaacttgctaagaaactcacagccaaccactgcagttagtgatagagcttagaaagtgccccactcccaactctttcatttcgttgcttcttcatggctcctccaacatcagaccccccacttgtgaacatttacggcaaaatttcccaaatgcctgatgagatgagaagcaagtcaatacctcctaaatatgcatgagctgttcaacggttcaatctcggtgggtagcaatatgtctatcaggatctatttattctcatgacttcagtgctgctctggagcgatgcattatgaacaatttatggtgtgttgacaggacagatgaatgctaggagaataggctgacggggagaaaatctcactctggcaaacggaatgcagaggtgtgactctgagcaggcggaaggaagagaatgtgatggttcacgtgtttagccgattgtgtgccagcctgcagccctgtagttttgtgccacagcctctgcttgcactgcctgtcttcacaacaggacctgcagaatctccccttccccaaagggcagccctacggctggggaggtgcagttgtcagcagcctgtaagcatgaacacccttgtattcctgatgccttggtgacttttggatggagaagtcactttgttcactaagccctaaaatcatctcactcaagtttttggtgaagattaagtttctgaacatcaagactaaaagctgtggctactttgtttgatcatttagagctgctgctttggaaagtgtgtctgaggtgagagccagtaaatggcgggcattctctccagcaatgggcatctatccttctctgccatttggaatgatcatctacgtttaatacttacccagagtcagggcaggacactgcttctcttaaccctacatacctcgcttataaaagccccaaacaagttttttgtttgtttgtttttcaatgtacctgtattttctttttttgtaaattgacatcttgagtttttcaattcgtgaacatggtgtatttccccatttatgttggttttctggagtatctttaagtagttatatagttttcttcttctatgccttgcacatattttcttttttaaaaaattttattattattttactttaagttttagggtacatgtgcacaatgtgcaggtttgttacatatgtatacatgtgccatgttggtgtgctgcacccattaactcgtcatttagcattaggtatatctcctaatgctatccctcccctcttcccccaccccacaacagtccccagagtgtgatgttccccttcctgtgtccatgtgttctcattgttcaattcccatgtatgagtgagaacatgtggtgtttggttttttgtccttgcgacagtttgctgagaatgatggtttccagcttcatccatgtccctacaaaggacatgaactcatcatttttttatggctgcatagtattccatggtgtatatgtgccacattttcttaatccagtctatcattgttggacatttgggttggttccaagtctttgctattgtgaatagtgccacaataaacatatgtatgcatgtgtctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttttttttattattatactttaagttttagggtacatgcgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccgtggtgtatatgtgccacattttcttaatccagtctatcattggtggacatttgggttggttccaagtctttgctattgtgaataatgctgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacagtaccaccaacagtgtaaaagtgttcctatttctccacatcctctccagcacctgttgttccctgactttttaatgattgccattctaactggtgtgagatggtatctcattgtgttttgatttgcatttctctgatggccagtgatgatgagcattttttcacgtgttttttgtctgcataaatgtcttcttttgagaagtgtctgtttatatcctttgcccactttttgatggggttgtttttttcttgtaaatttgtttgagttcattgtagattctggatattagccctttgtcagatgagtaggttgcaaaatttttctcccattctgtatgttgcctattcactctgatggtggtttcttttgctgtgcagaagctctttagtttaattagatcccatttgtcaattttgtcttttgttgccattgcttttggtgttctagacatgaagtccttgcccatgcctatgtcctgaatggtattgcctaggttttgttctagggtttttatggtgttaggtctaacatgtaagtctttaatccatcttgaattaatttttgtataaggtgtaaggaagggatccagtttcagctttctacatatggcgagccagttttcccagcaccatttattaaacatggaatgctttccccattgcttgtttttgtaaggtttgtcaaagatcagatagttgtagatatgcggcattgtttctgagggctctgttccgttccattggtctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaaccttaaagtgtttttttccaattctgtgaagaaagtcattggtagtttgatggggatggcactgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtatttgattctctttgaaacaattgtgaatgggagttcactcatgatttggctctctgtttgtctgttattggtgtataagaatgcttgtgatttttgtacattgattttgtatcctgagacgttgctgaagttgcttatcagcttaaggagattttgggctgagacaatggggttttccagatatacaatcatgtcatctgcaaacagggacaatttgacttcctcttttcctaattgaatgccctttatttccttctcctgcctaaatgccctggccagaacttccaacactatgttgaataggagtggtgagagagggcatccgtgtcttgtgcccgttttcaaagggaatgcttccagtttttgtccattcagtatgatattggctgtgggtttgtcatagatagctcttattattttgagatatgtcccatcaatacctaatttattgagagtttttagcatgaaggattgttggattttgtccaaggccttttctgcaactatggagataaccatgtggtttttgtctttggttctgtttatatgctggattacgtgtattgattttcgtatggtgaaccagccttgcatcccagggatgaagcccacttgatcatggtggataggctttttgatgtgttgctggattcggtttgccagtattttattgaggatttgtgtatcaatgttcatcaaagatattggtctaaaattctctttttttgctgtgtctctaccaggctttggtatcaggattatgctggcctcataaaatgagttagggaggattctctctttttctattgattggaatagtttcagaaggaatggtactagctcctccttgtacctctggtagaattcagctgtgaatccatctggtcctggacttttttgttgttggtaggctattaattattgcctcaatttcagatcctgttattggtctattcagagattcaatttcttcctggtttagtcttgggagggtgtatgtgtcaaggaatttatccatttcttctagattttctagtgtatttgtgtagaggtgtttatagtattctctgatggtagtttgtatttctgtgggatcggtggtgatatcccctttatcatgttttattgcatgtatttgattcttctctcttttcttctttattagtcttgctagcggtctatcagttttgttgatcttttcaaaaaaccagctcctggattcactgattttttttgaagggttttttgtgtctctatttccttcagttctgctctgatcttagttatttcttgccgtctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcatttcgttatgtacccagcagtcattcaggagcaggttgttcagtttccatgtagttgagtggttttgagtgagtttcttaatcctgagttctagtttgattgcactgtggtctgagagatagcttgttataatttcttttattttacatttgctgaggagtgctttacttccaactatgtggtcaattttggaataggtatggtgtggtgctgaaaagtatgtatattctgttgatttggggtggagagttctgtagatgtctattaggtctgcttggtgcagagctgagttcaattcctggatatccttgttaactctctgtctcgttgatctgtctaatgttgacagtggggtgttaaagtctccctttattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatcttttttggtttaaagtctgtcttatcagagactaggattgcaacccctgcctttttttgttttccatttgcttggtagatcttcctccatccctttattttgagcctatgtgtgtctctctgcacatgagatgggtttcctgaatacagcacactgatgggtcttgactctttatccaatttgctagtctgtgtcttttaattggagcatttagcccatttacatttaatgttaatattgttacgtgtgaatttgatcctgtcattatgatgttagctggttattttgctcgttagttgatgcagtttcttcctagccttgatggtctttacaatttggcatgtttttgcagtggctgataccggttgttcctttccatgtttagtgcttccttcatgagctcttttagggcaggcctcgtggtgacaaaatctctcagcatttgcttgtctgtaaagtatcttatttctccttcacttatgaagtttagtttggctggatatgaaattctcggttgaaaattcttttctttaagaatgttgaatattggcccccactctcttctggcttgtagagtttctgccaagagatccactcttagtctgatgggcttccctttgtgggtaacccgacctttctccctggctgcccttaacattttttccttcatttccactttggtgaatctgacaattatgtgtcttggagttgctcttctccagaagtatctctgtggtgttctctttatttcctgaatttgaatgttggcctgccttgctagattggggaaattctcctggataatatcctgcagaatgttttctaacttggttccattctccccgtcactttcaggtacaccaatcagacgtagatttggtcttttcacacagtcccatattttttggaggctttgttcatttatttttattcttttttctctaaacttatcttctcacttcatttcattcattttatcttccattgctgataccctttcttccagttgattgcatcggctactgaggcttgtgcattcgtcacgtagttctcatgccatggctttcagctccatcaggtcctttaaggacttctcttcattggttattctagttagccattagtctaattttttttcaagatttttaacttctttgccattggttcgaacttcctcctttagcttggagtagtttgatcttctgaagccttcttctctcaacttgtcaaagtcattctccatccagctttgttccattgctggtgaggagctgtgttcctttggagaaggagaggcactctgatttttagagtttctggtttttctgttctgttttttccccatctttgtggttttatctacctttggtctttgatgatggtgatgtacagatgggtttttggtgtggatgtcctttctgtttgttcgttttccttctaacagtcaggaccctcagctgcaggtctgttggagtttgctggaggtccactccaacaaactcctgggtatcagcagcagtggctgcagaacagcagatattggtgaaccgcaaatgctgctgcctgattgttcctctggaagttttgtctcagaggagtacccggctgtgtgaggtgtcagtccacccctactggggggtgcctcccagttaggctactcggggttcagggacccacttgaggaggcagtccgcctgttctcagatctcaagctgcatgctgggagaaacactactctcttcaaagctgtcagacagggatatttaagtctgcagaggttactgctgccttttgt

SEQ ID NO: 12616 - DNA, 6055 bp, Homo sapiens
tttttaagttcttttttatttatttattttttattattatactttaagttttagggtacatgtgcacaatgtgcaggttagttacatatgtatacatgtgccatgctgatgcgctgcacccactaactcatcatctagcattaggtatatctcccaatgctatccctcccgcctccccccaccccacaacagtccccagagtgtgatgttccccttcctgtgtccaggtgttctcattgttcaattcccacctatgagtgagaatatgtggtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacctacgtgtgcatgtgtctttatagcagcatgatttatagtcctttggttatatacccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgttggtttttttcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttcgcttttgttgccattgcttttggtgttttagacatgaagtccttgcccatgcctatgtcttgaatggtaatgcctaggttttcttctagggtttttatggttttaggtctaacatttaagtctttaatccatcttgaattgatttttgtataagatgtaaggaagggatccagtttcagctttctacatatggctagctagttttcccagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggatcttttttggttccatatgaactttaaagtagttttttccaattctatgaagaaagtcattggtagcttaatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgttccagttttcaaagggaatgcttccagtttttgcctattcagtatgatattggctgtgggtttgtcatagatagctcttattattttgagatacatcccatcaatacctaatttattgagagtttttagcatgaagtgttgttaaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttcatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagttccagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttgcgtagacatgtttgtagcattctctgatggtagtttgtatttctgtgggatcggtggtgatatcccctttatcattttttattgcgtctatttgattcttctctctttttttctttattagtcttgctagtggtctatcaattttgttgatcctttcaaaaaaccagctcttggattcgttaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgtttagtttccatgtagttgagcggttttgagtgagattcttaatcctgagttctagtttgattgcactgtggtctgagagatagtttgttataatttctgttcttttacgtttgctgaggggagctttacttccaactatgtggtcaattttggaataggtgtggtgtggtgctgaaaaaaatgtatattctgttgatttggggtggagagttctgtagaagtctattaggtctgcttggtgcagagctgagttcaattcctgggtatccttgttgactttctgtctggttgatctgtctaatgttgacagtggggtgttaaagtctcccattattaatgtgtgggagtctaagtctctttgtaggtcactcaggacttgctttatgaatctgggtgctcctgtattgggtgcatatatattgaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggccctcactctcttctggcttgtagagtttctgctgagagatcagctgttagtctgatgggcttcgttttgtgggtaacccgacctttctctctggctgcccttaacattttttccttcatttcaactttggtgaatctgacaattacgtgtcttggtgttgctcttctcaaggagtatctttgtggcattctctgtatttcctgaatctgaatggtggcctgccttgctagactggggaagttctcctggataatatcctacagagtgttttccaacttggttccattctccccatcactttcaggtacaccaatcagacatagatttggtcttttcacatagtcccatatttcttggaggctttgctcgtttctttttattcttttttctctaaacttcccttctcacttcatttcatacatttcatcttccatcgctgataccctttcttccagttgatcacatcggctcctgagtcttctgcattcttcacttagttctcaagccttggttttcagctccatcagctcctttaagcacttctctgtattgattattctagttatacattctcctaaatttttttcaaagttttcaacttctttgcctttggtttgaatgtcctcccgtagctcagagtaatttgatcgtctgaagccttcttctctcagctcgtcaaagtcattctccgtccagctttgttccattgctggtgaggaactgcattcctttggaggaggagaggcgctctgctttttagagcttccagtttttctgttctgttttttccccatctttgtggttttatctacttttggtctttgatgatggtgatgtacagatgggttgttggtgtggatgtcctttctgtttgttagttttccttctaacagacaggaccctcagctgcaggtctgttggagtgcccggccgtgtgaggtgtcagtctgcccctgctagggggtgcctcccagttaggctgctggggggtcaggggtcagggacccacttgaggaggcagtctgcccgttctcagatctccagctgcatgctgggagaaccactgctctcttcaaagctgtcagacagagacatttaagtctgcagaggttactgctgtctttttgtttgtctgtgccctgcccccagaggtggagcctacagaggcaggcaggcctccttgagctgtggtgggctccacccaattcgagcttcccggctgctttgtttacctaagcaagcctgggcaatggcgggtgcccctcccccagcctcgctgccaccttgcagtttgatctcagagtgctgtgctagcaatcagcgagactccgtgggcctaggaccctccgagccaggtgcgggatataatctcctggtgtgccgttttttaagcccgtcggaaaagcgcagtattcgggtgggagtgacccgattttccaggtgccatctgtcaccactttgtttgactaggaaagggaactccctgaccccttgcgcttcccgagtgaggcaatgcctcgccctgcttcggctcgcacacggtgcgcgcactcactgacctgcacccactgtctggcactctctagtgagatgaacccggtacctcagatggaaatgcagaaatcacccgtcttctgcgtggctcacactgggagctgtagactggagctgttcctattcggccatcttggctcctcccgcc

SEQ ID NO: 12617 - DNA, 6074 bp, Homo sapiens
  misc_feature (5787)..(5787): n equals a,t,g, or c
ttcttttttttttttcttcttttttttctttttttttttttttaatgttttttttttattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatacatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctcttcatgtccttcgcccactttttgatggggttgtttgtttttttcttgtaaatttgttggagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatgtaatgcctaggtttcttctagggctcttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtctttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggcagcttgatggggatggcattgaatctgtaaattaccttgggcagcatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacttatgatttggctctctgtttgccggttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagaggacatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctcagcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaatccttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagtttccaacttctttgcctttggtttgaatgtcctcccgtagttcagagtaatttgatcgtctgaagccttcttctctcagctcgtgaaaatcattctccatccagctttgttccattgctggtgaggaactgcgttcatttggaggaggagaggcgctctggcttttagagtttccagtttttctgttctgttttttccccatctttgtggttttatctacttttggtctttgatgatggtgatgtacagataggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccataggtggagcctacataggcaggcaggcctccttgagctgtggtgggctccacccagttggagcttccccgctgctttgtttacctaagcaagcctgggcaatggtgggcgcccctcccccagcctcgttgccgccttgcagtttgatctcagactgctgtgctagcaatcagcgagattccgtgggcgtaggaccctctgagccaggtgtggatatagtctcgtggtgcgccgttttataagccggtctgaaaggcgcataatncgggtgggagtgacccatttttccaggtgcgtccatcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccggtacctcagatggaaatgcagaaatcacccgtcttctgcgtcgctcacgctgggagctgtagaccagagctgttcctattcggccatcttggctcctccccag

SEQ ID NO: 12618 - DNA, 5236 bp, Homo sapiens
attattattatacttgaagttttagggtacatgtgcacaatgtgcaggttagttacatatgtatacatgtgccatgtggtgtgctgcacccattaactcctcatttagcattaggtatatctcctcccccctccccacaacccacaacagtccccggtgtgtggtgttccccttcctgtgtccatgtgttctcattgttcaattcccacctatgagtgagaacatgcggtgtttggttttttttccttgcgatagtttgctgagaatgatggtttccagtttcatccatgtccctacaaaggacatgaactcatcgttttttatggctgcatagtattccatggtgtatatgtgccacattttcttaatccagtctatcgttcttggacatttgggttggttccaagtctttgctattgtgaatagtgtcgcaacaaacatacgtgtgcatgtgtctttatagcagcatgatttataatcctttgggtatatacccagtaatgggaaggctgggtcaaatggtatttctagttctagatccctgaggaatcgccacactgacttccacaatggtgaaccacaatggttccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttcagaagtgtctgttcatatcctttgcccactttttgatggggttgtttgttcttttcttgtaaatttgtttgaattcattgtagattctggatattagccctttgtcagatgagtaggttgtgaaaattttctcccattttgtaggttgcctgttcactctgatggtagtttcttttgctgtgcagaagctcttcagtttaattagatcccatttgtcaattttggcttttgttgccattgcttttggtgttttagacacgaagttcttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatccttttcccattgcttgttttttctcaggtttgtcaaagatcagatagttgtagatatgtggtgttatttctgagggctctgttctgttccattgatctatatctccgttttggtaccagtaccatgctgttttggttactgtagccttgtagtatagtttgaagtcaggtagtgtgatgcctccagctttgttcttttggcttacgattgacttggcgatgcaggctcttttttggttccttatgaactttaaagtagttttttccaattctgagaagaaagtcattggtagcttgatgaggatggcattgaatctataaattaccttgggcagtatggccattttcacgatattgattcttcctacccatgagcatggaatgttcttccatttgtttgtatcctcttttatttcattgagcagtggtttgtagttctccttgaagaggttcttcatgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctaaagttgcttatcagcttaaggagattttgggctgagacaatggggttttctagatatacaatcatgtcatctgcaaacagggacaatttgacttcctcttttcctaagtgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagacagttcttattattttgagatatgtcccatcaatacctaatttattgagagtttttagcatgaagggttgttgaattttgtcaagggccttttctgcatctattgagataatcgtgtggtttttgtctctggttctgtttatatgctggattacgtttattgatttgcgtatgttgaacccgccttgcatcccagggatgaagcccacttgatcatggtggataagctttttgatgtgctgctggatttggtttgctagtattttattgaggacttttgcatcaatattcatcaaggatattggtctaaaattctcttttttggttgtgtctctgccaggctttggtatcaggatgatgctggcctcataaattgagttagggaggattccctctttttctattgattggaatagtttcagaaggaatggtaccagctcctccttgtacctctggtagaattcggctgtgaatccatctggtcctggactttttttggttggtaagctattgattattgccacaatttcagagcctgttattggtctattcagagattcaacttcttcctggtttagtcttgggagggtgtatgtgtccaggaatttatccatttcttctagattttctagtttatttgtgtagaggtgtttgtagtattctctgattgtagtttgtatttctgtgggaacagtggtgatatcctctttgtcattttttattgcgtctatttgattcttctctcttttcttctttattagtcttgctagtggtctatcaattttgttgatcttttcaaaaaaccagctcctggattcattaattttttgaagggttttttgtgtctctgtttccttcagttctgctctgattttagttatttcttgccttctgctagcttttgaatgtgtttgctcttgcttttctagtgcttttaattgtgacgttagggtgtcaattttggatctttcctgctttctcttgtgggcatttagtgctataaatttccctctacacactgcttcgaatgtgtcccagagattctggtatgttgtgtctttgttctcgttggtttcaaagaacatctttatttctgccttcatttctttatttatccagtagtcattcaggagcaggttgttcagtttccacgtagttgagtggttttgagtgagtttcttagtcctgagctctagtttgattgcactgtggtctgagagacagtttgttataatttctgttctttcacatttactgagaagtgctttacttccaactatgtggtcaattttggaataggtgtggtgtggtgctaaaaaaaatgtatattctgttgatgtggggtggagagttctgtagatgtctattaggtctgcttggtgcagagctgagttcaattcgtgtgtatcctttttaactttctgtctcgttgatctgtctaatgttgacagttaaacattaataattatgggtgttaaagtctcccattattattgtgtgggagtctaagtctttttgtaggtcactcaggacttgcattatgaatctgggtgctcctgtattgggtgcatgtatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcctcctccatccctttatttgagcctatgggtgtctctgcatgtgagacaggtctcctgaatacagcacactgatgggtcttgactctttatgcaatttgccagtctgtgtcttttaattggagcatttagcccatttacatttaaagttaatattgttatgtgtgtatttgatcctgtcattatgatgttagctggctattttgctcattagttcatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctgggtatgaaattctgggttgaaaattcttttctttaagaatgttgaatattggcccccactgtcttctggcttgtagagtttctgcccagagatctgctgttagtctgatgggcttccctttgtgggtaacccgacctttctctctggctgcccttaacattttttcctccatttcaactttggtgaatctggcaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttaaggtacaccaatcagacgtagatttggtcttttcacatagtcccacatttcttggaggctttgttcgtttctttttattcttttttctctaaacttcccttctcgcttcatttcattcatttcgtcttccatcactgataccctttctttcagttgattgcatcggctcctgaggcttctgcattcttcacgtagttctcgagccttggctttctgctccatcagctcctttaaggacttctctgcgttggtttttctagttatccatttgtctaatttttttcacagtttttaacttctttgccattggtttgaatttcctcctgtagcttggagtagtttgattgtctgaagccttcttctctcagctcatcaaagtcattctccatccagctttgttccattgctggtgaggagctgctctcctttggaggaggagaggtgctctgctttttagagtttccagtttttctgctctgttttttccccatctttgtggtttaactacctttggtctttgatgatggtgatgtacagatggggttttggtgtggatgtcctttctgtttgttagttttccttctaacagacaggacccttagctgcagg

SEQ ID NO: 12619 - DNA, 6046 bp, Homo sapiens
tttttttcttcaacttttttttttaattatactttaagttttagggtacatgtgcacattgcgcaggttagttacgtatgtatacatgtgccatgctggtgcgctacacccactaactcgtcatctagcattaggtatatctcccaatgctatccctcccacctccccccaccccaccacagtctgcagagtgtgatattccccttcctgtgtccatgtgatctcattgttcaattcccacctatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgaattccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttgctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttctaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatgataatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccaataccatgctgttttggttactgtagccttgtagtatagtttgaagtcaggtagtgtgatgcctccagctttgttcttttggcttaggattgacttggcaatgcaggctcttttttggttccatatgaactttaaagtagttttttccaattctgtgaagaaaggcattggtagcttaatggggatggcattgaatctgtaaattaccttgggcagtatggccattttcacgatattgattcttcctacccatgagcatggaatgttcttccatttgcttgtatcctcttttatttccttgagcagttgtttgtagttctccttgaagaggtccttcacatcccttgtaagttggattcctaggtattttattctctttgaagcagttgtgaatgggagttcactcatgatttggctctctgtttgtctgttgttggtgtataagaatgcttgtgacttttgtacattgattttgtatcctgagactttgctgaagttgcttatcagcttaaggagattttgggctgagacaatggggttttccagatatacaatcatgtcgtctgcaaacagggacaatttgacttcctcttttcctaattgaataccctttatttccttctcctgcctaattgccctggccagaacttccaacactatgttgaataggagtgatgagagagggcatccctgtcttgtgccagttttcaaagggaatgcttccagtttttacccattcagtatgatattggctgtgtgtttgtcatagatagctcttattattttgaaacacgtcccatcaatacctaatttattgagagtttttagcatgaaaggttgttgaattttgtcaaaggctttttctgcatctattgagataatcatgtggttttcgtctttggctctgtttatatgctggattacatttattgatttgtgtatattgaaccagccttgcatcccagggatgaaacccacttgatcatggtggataagctttttgatgtgctgctggattcggtttgccagtattttattgaggagttttgcatcaatgttcatcaaggatattggtctaaaattctcttttttggttgtgtctctgcccagctttggtatcagaatgatgctggcctcataaaatgagttagggaggagtccctctttttctactgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtaaaagtgtttgtagtattctctgatggtagtttgtatttctgtgggatctgtggtgatatcccctttatcattttttattgcgtctatttgatttttctctctttttttctttattagtcttgctagcagtctatcaattttgttgttcctttcaaaaaaccagctcctggattcactaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcactcaggagcaggttgttcagtttccatgtagttgagtggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagacactaggattgcaacccctgcctttttttgttttccatttgcttggtagatcttcctccatccttttattttgagcctatgtgtgtctctgcacgtgagatgggtttcctgaatacagcacactgatgggtcttgagtctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcacttatgaaacttagtttggctggatatgaaattccgggttaaaaattcttttctttaagaatgttgaatattggcccccactctcttctggcttgtagggtttctgccgagagatccgctgttagtctgatgggcttccctttgaaggtaacccgacctttctctcttgctgcccttaacattttttccttcatttcaactttggtgaatctgacaattatgtgtcttggagttgctcttctcgaggagtatctttgtggcattctctgtatttcctgaatctgaacgttggactgccttgctaggttggggaagttctcctggataatatcctgcagagtgttttccaacttggttccattctccccatcactttcagttacaccaatcagacgtagatttggtcttttcacatagtcccatatttcttggaggctttgctcgtttctttttattcttttttctctaaacttcccttctcgcttcatttcattcatttcatcttccattgctgacaccctttcttccagttgatcgcatcggctcctgaggcttctgcattcttcacgtagttctcgagccttggttttcagcttcatcagctcctttaagcacttctctgtattggttattctagttatacattcttataaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccttgtgagctgtcagtgtgcccctgctgggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccttcccccagcctcgctgccgccttgcagtttgatctcagactgctgtgctagcaatcagggagactccgtgggcctaggatcctccgagccaggtgcgggatataatctcgtggtgcaccgttttttaagcaggtcagaaaagcgcagtattcgggtgggagtgacccgattttctaggtgcgtctgtcacccctttctttgactcggaaagggaactccctgaccccttgcgcttcccaagtgaggcaatgcctcgccctgcttcggctggcgcatggtgcacgcacccactgacctgcgcccactgtctggcactccctagtgagatgaacccggtacctcagatggaaatgcagaaatcacccgtcttctgtgtcgctcatgctgggagctgtagactggagctgttcctattcggccatcttggctcctccccattt

SEQ ID NO: 12620 - DNA, 7417 bp, Homo sapiens
attgatttttttttttttaccattattattttttcttttttttttattattatactttaagttttagggtacatgtgcacattgtgcaggttagttacatatgtatacatgtgcgatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattcccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgttttttttttcttgtaaatttggttgagttcattgtagattctggatattagccctttgtcagatgagtaggttgcaaaaattttctcccatgttgtaggttgcctgttcactctgatggtagtttctcttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcagatttgtcaaagatcagacagttgtaggtatgtcgtgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcgatgcaggctcttttttggttccacatgaactttaaagtagttttttccaattctgtgaagaaagtcattggtagcttgatggcgatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggacttcactcatgatttggctctctgtttgtctgttgttggtgtataagaatgcttgtgatttttgtacattgattttatatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagcatgatattggctgtgggtttgtcatagatagctcttattattttgaaatacgtcccatcaatacctaagttattgagagtttttagcatgaagggttgttgaattttgtcaaagtctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattaagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagaacatctttatttctgccttcattttgttatgtacccagtagtcattcaggagcaggttgttcagtttccatgtagttgagcggctttgagtgagtttcttaatcctgagttctagtttcattgcactgtggtctgagagatagtttgttataatttctgttcttttacatttgctgaggagagctttacttccaactacgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcattttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtactggttgttcctttccatgtttagcgcttccttcaggagctcttttagggcaggcctggtggtgacaaaatctctcagcatttgcttttctgtaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacattggcctgccttgctagattggggaagttctcctggataatatcctgcagagtgttttccaacttggttccattctccccatcactttcaggtacaccaatcagaggtagatttggtcttttcacatagtcccatatttcttggaggctttgctcatttctttttattcttttttctctaaacttcccttctcacttcatttcattcatttcatcttccattgctgacaccctttcttccagttgatcgcatcagctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttggaggaggagaggcgctctgatttttagagcttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccatgtgaggtgtcagtgtgcccctgctggggggtgcctcccagttaggctgcttgggggtcaggggtcagggacccacttgaagaggcagtctgccggttctcagatctccagctgcgtgctgggagaaccactgctcccttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatgttcgggtgggagtgacccgattttccaggtgcgtccatcacccctttctttgactcggaaagggaactctctgaccccttgcgcttcccaggtgaggcaatgcctcgccctgcttcggctcgcgcacggtgcgcgcacccactggcctgcgcccactgtctggcactccctagtgagatgaacctggtacctcagatggaaatgcagaaatcaccggtcttctgcatcggtcacgctgggagctgtagaccggagctgttcctattcggccatcttggctcctcccccgcatccattgattttttaacaaaggtaccgacacaattcctgtattagtccattctcacattgctataaagaactgcctgagattgggtaatttataaaggaaagtagttcaatcgcatggcagaaggggaagcaaaggcatctttcttcacatgatgacaggtaggagaagtgcagagcaacaggggaaaaaaccccttataaaaccatcagatctcgtgagaatgcactcactatcccgagaacaggatggaggaaactgcccgcatgattcaattatctccaggacatgtggagattatgggaactcaaattcaagatgagatttgggtagggacacagccaaaccataacaattcctttgggaaagcaagttcccaaatggtgtttgaacaacggaaaattaaattagtaaatctcaacctcctacatcactctatgtacaaaaattatttcaagattaatcattgacttaaaataaaagttagaaaaataaagcatctagaaaaaacattgaagtagatcttcatacgtttgagataggcaaagatttctttagagcataaaaagcaccaaacataaaacaaaacttgataaattacacaacatcaaaaataagaacttctgcacattaaaaaatgttataagaaataaaatcaagcttcagacttggagaaaatatttacaacacaattattttacaatacaaatatctaacaaaggacttgtatttagaatatataacgacctgcaaatcaataatgaagaaatctactcaataaatatgcatataatatgtaaacattttaccaaaaaaaatgactgttcaacatgaacataaaaaggtgcttatcagggaaataacaattaaaaccaccacaagatacatactagaatgtttaaaataaaaaggactgaaaataccaagttttggcaaggaagtgaaaccactgggaactctcatatattgctggtggaaatgtgaaatatcacaaccatttaaaaaaacctgtggcagtaccttttaaagttggatatacatggtatccatgaatccattcctaggtgtctaccttaaaaaaaagtgaaaacatttttcactggaaaatgttaaagatgtttcattgtagaactttttctccagtgaaaaagtaaaaccttttaacttttttttttttttttttttttgagatggagtctcgctctgtcacccaggctggagtgcagtggcatgatctcggttcactgcaagctctgcctctcggattcaccccattctcctgcctcagtctcccgagtagctgggactacaggagcccaccaccacgcccggctaattttttgtattttt

SEQ ID NO: 12621 - DNA, 5381 bp, Homo sapiens
tatgtatattattatttttttctttttttttttattgtactttaagttttagggtacatgtgcacattgtgcaggttagttacatatgtatacatgtgccatgctggtgcgctgcacccactaactcatcatctagccttaggtatatctcccaatgctatccctccccgctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgttttctgtctttttaatgattgccattctaactggtgtgagatgatatctcatagtggttttgatttgcatttctctgatggccagtgatgatgaacattttttcatgtgttttttggctgcataaatgtcttcttttgagaagtgtctgttcatgtccttcgcccactttttgatggggttgtttgtttttttcttgtaaatttgcttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttcttcttttggcttaggattgacttggtgatgcgggctcttttttggttccatatgaactttaaagtagttttttccaattctgtgaagaaagtcattggtagcttgatggggatggcattgaatctgtaaattatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcatctgcaaacagggacaatttgacttccgcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatgttggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctatcgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttctaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcatggtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgtttggtagatcttcctccatccttttattttgagcctatgtgtatctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaaaccgacctttctctctggctgcccttaacattttttccttcatttcaactttggtgaatcggacaattatgtgtcttggagttgctcttctcgaggagtatctttgtggcgttctctgtatttcctgaatctgaacgttagcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgaaccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaggcttcttctctcagctcgtcaaagtcattctccaaccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgcttgggggtcaggggtcagggacccacttgaggaggcagtctgccct

SEQ ID NO: 12622 - DNA, 8041 bp, Homo sapiens
tttttttatttttattttttattttattttattattattatactttaagttttagggtacatgtgcacaatgtgcaggttagtttcatatgtatacatgtgccatgctggtgtgctgcacccattaactcgtcatttagcattaggtatatctcctaaagctatccctccccctgcccccaccctgcaacagtccccagagtgtgatgttccccttcctgtgtccatgtgttctcattgttcagttcccacctatgagtgagaatatgcggtgtttggtttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttatagcagcatgatttatagtcctttgggtatatacccagtaatgggatggctgggtcaaatggtatttctatttctagatccctgaggaatcaccacactgacttccacaagggttgaactagtttacagtcccaccaacactgtaaaagtgttcctgtttctccacatcctctccagcacctgttgtttcctgactttttaatgattgccattctaactggtgtgagatggtatctcattgtggttttgatttgcatttctctgatggccagtgatggtgagcattttttcgtgtcttttttggctgcataaatgtcttcttttgagaagtgtctgttcatatccttcgcccactttttgatgcggttgtttgtttttttcttgtaaatttgtttgagttcattgtagattctggatattagccctttgtcagatgagtaggttgcgaaaattttctcccattttgtaggttgcctgttcactctgatggtagtttcttttactgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtcgaacgtttaagtctttaatccatcttgaattaatttttctataaggtgtaaggaagggatccagtttcagctttctacctatggcaagccagttttcccagcaccatttattaactagggaatcctttccccattgcttgtttctctcaggtttgtcaaagatcagatagttgtagatatgcggtgttatttctgagggctctgttctgttccattgatctatatatctgttttggtaccagtaccatgctgttttggttactgtagccttgtagtatagtttgaaatcaggtagcatgatgcctccagctttgttcttttggcttaggattgacttggtggtgtgggctcttttttggttccatatgaactttaaagtagttttttccaattctgtgtagaaagtcattggtagcttgatggggatggcattgaatctataaattaccttgggcagtatggccattttcacaatattgattcttcctacccatgagcatggaatgttcttccatttctttgtatcctcttttatttcattgagcagtggtttgtagttctccttgaagaggtccttcacatcccttgtaagttggagtcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacattggggctttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatacatagctcttattattctgagatacgttccatcaatacctaatttattgagagtttttagcatgaagcattgttgaattttgtcaaaggccttttctgcgtctattgagataatcatgtggtttttgtcttttgttctgtttatatgctggattacatttattgatttgtgtatattgaaccagccttgcatcacagggatgaagcccacttgatcatggtggataagccttttgatgtgctgctggatttggtttgccagtattttactgagtatttttgcatcagtgttcatcaaggatattggtctaaaattctcttttttggttttgtctctgcctagctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagttattgattattgccacaatttcagatcctgtgattcagatcctgtgattcagatcctgtgtattcagagagtcaacttcttcctggtttagtcttgggagggtgtatgtgtccaggaatttatccatttcttctagattttctagtttatttgtgtagaggtgtttgtagtattctctgatggtagtttgtatttctgtgggatcggtggtgatatcccctttatcattttttattgcatctatttgattcttctctcttttcttctttattagtcttgctagtggtctatcaattttgttgatcctttcataaaaccagctcctggattcattaattttttgaagggttttttgtgtctctatttccttcagttctgctctgatcttagttatttcttgccttctgctagcttttgaatgtgtttgctcttgcttttctgtgtcttttaattgtgatgttagggtgtcaattttaaatctttcctgctttctcttgtgggcatttagtgctataaatttccctctacacactgctttgaatgtgtcccagagattctggtgtgttgtgtctttgttttcgttggtttcaaagaacatctttatttctgccttcatttcattatgtacccagtagtcattcaggagcaggttgttcattttccacgtagttgagtggttttgagtgagtttcttaatcctgagttctagtttgattgcactgtggtctgagagacagtttgttataatttctgatcttttacatttgctgaagagagctttacttccaactatgtggtcaattttggaataggtgtggtgtggtgctgaaaaaaatgtatattctgttgatttgggttggagagttctgtagatatctattaggtccgcttggtgcagagctgggttcaattcctgggtatccttgttaactttctgtctcgttgatctgtctaatgttgacagtggggtgttaaagtctcccattattattgtgtggcagtctaagtctctttctaggtcactcaggacttgctttatgaatctgggtgctcctgtattgggtgcatatatacttaggatagttagctcttcttgttgaattgatccctttaccattatgtaatggccttctttgtctcttttgatgtttgttggtttaaagtctgttttatcagagactgggattgcaacccctgcctttttttgttttccatttgcttggtagattttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggctattttgctcgttagttgatgccgtttcttcctagcctcgatggtctttacaatttggcatgattttgcagtggctgccaccggttgttcctttccatgtttagtgcttccttcgggagctcttttagggcaggcctggtggtgacaaaatctctcagcatttgcttgtctgtaaagtattttatttctccttcacttatgaagcttagtttggctggatatgaaattctgggttgaaaattcctttctttaagaatgttgaatattggcccccactctcttctggcttgtagagtttctgccgagagatccgctgttagtctgatgggcttccctttgtgggtaacccgaccttcatctctggcctcccttaacattttttccttcatttcaacttttgtgaatctgacaattatgtgtcttgagttgctctttttgaggagtatctttgtggcgttctgtatttcctgcatctgaacgttggcctgccttgctagattggggaagttctcctggataatatcctgcagagtgttttccaacttggttccattctccccatcactttcaggtacaccaatcagacgtagatttggtcttttcacatagtctcatatttcttggaggctttgttcgtttctttttattctgttttctctaaacttcccttctcgcttcatttcattcacttcatcttccatcactgataccctttcttccagttgatcgcatcagctcctgaggcttctgcattcttcacgtagttctcgagccttggctttcagctccatcagctcctttacgtacttctctgtattagttattctagttatacattcgtcaaaatcattttcaaagttttcaacttctttgcctttggtttgaatttcctcctgtagctcagagtagtttgatcgtctgaagccttcttctctcaactcgtcaaagtcattctctgtccagctgtgttccgttgctggtgaggagctgcgttcctttggaggaggagaggtgctctgctttttagagtttccagtttttctgctgtgttttttccccatctttgcggttttatctacttttggtctttgatgatggtgatgtacagatgggtttttggtgtggatgtcctttctgtttgttagttttccttctaacagacaggaccctcagctgcaggtctgttggagtttgctagaggtccactccagaccttgtttgcctgggtaccagcagcggtggctgcagaacagtggatttttgtgaaccgcaaatgctgctgtctgatcgttcctctggaatttttgtctcagaggagtacccggccgtgtgaggtgtcagtctgcccctactggggggtgcctcccagttaggctgctcgggggtcaggggtcagggacccacttgaggaggcagtctgccctttctcagatctccagctgcgtgctgggagaatcactgctctcttcaaagctcagatggaaatgcagcctctaatatctctatttggctcacaaccctcaagtagttctcttcagggtttcagcaaatcttgccctataaatgcctaatattaagccagtggcttaaggtgaccttagaaaagatttctgaagcttcatctctaaacagctacctcctctctactaacctgcttcataaatcccagccacaatgctaataatgtctaccttagacaccatcaatttctctttgggttctatttcactgcgttcctaatcaaaaagccagggtaaatgtgttgcttacctccagtagttctttcttttccaggatagcagtgttgtggagtctgttgttagatgtctaaaaagagttgctgcttatgtattttttgagtgttatatttgtttatggctgaagggtaaatctaatagttataaccctgtcattattcagatgaagaatttgtcattttaagtttctcttttttatattcaccacctaccattctacagtattttttgattctttgtgggatttttctctgtctctacaataacttaacttccatgagaagtgattctgtcagtcttactcaattcagatctctagtgctcagaagagtgcttggtactcatgaataaacaacaaatatttaataaaattaaatgaaatgaatgagtaaattattgaataattatgcacagatgaaatttgcttcagaacatattaaaaattttacactagcaatataaaagaataggtgaatagatgttgaaaaaatttgtgcaaaacctatgatattgaagaagaaaataaggggcagacaaagaagtgaaggaataaaaaatgaagaagaaataagaagacagtaaaagaggaaaatggaaaagaagaaagtttgtagaattgtggagaaaaaaagacaaaaagacaagagaagaaatgaggatatttttgtaaaaaggaaaggaagaaaaagaaaagaggcaagtattattttaattctctaacacagcaaacatactgtgccctgactttgtattttaaggcaaaattctagggctgcaatggtgaaaatagttgggttattctttctaaacacctttatccccaaacatatttgccctgatgtgtaagaaatacacacaaaaatataatccaacttagattatgagtgccataggaaagtgctgtgagaagagtgatatcaaaaccttatatggggatctagctaggtaggcatcttagagaaagtgactaagtttgaaggatgaatagaaattaaacagatgttatgggaggaaacaatttgacaaaaggtttggaataaggaaaagaaagagcatggaacagaaattgtaaaagtttctgattggctttcctaataatgtctgaatgacgctgttgggaatgtgtattgggaatgcaagtttaagtctcacatggagagtctcgaatattgtgctaggagtttgaacttttaagtgctctttagcttttggaaacctctgagagtttttcaataagaaagtaataagctcagatcagtgattttagaacataaaatgtaattttaaaaagcagagaaataaatagaaaagagagagaaggcaactttgagcaaaacttttttcttaaaaaaagcgtttttggcacttagttctagaaatgatagaaaaacagatggaaaagatgttggtactggaaattattttatcagtctgtttttatcctgcttgctaagaaagggcatgacttttttattatgcatctaaggatctcttttactttgagccattttcacttggacacattatagttgagtgctgatattactgatgtgcttcctcccctaaatccccttgcccaacaggggttaagtcttgtaggcctaagtgtctgaaaactctgctcctctaacgtgaaaaatcaaacaaaaacaaatgaaacaccaccagttatcaggaatcagcgtttctctgcaacaaaagaaaatagaggatcatgttcacccactctgctttatttatgggaattaaattgggtttggtgtacagaatatctctatctcaataaaattcaagtgctgcgcagaagataaacggaatatacttttaaatgaaattgcttttcgttttggcagcagggtatttggtcattcaggaacttttgcacctctcacttttcacagaaggtcttttagagatgtatttcagctaaggagctcacctctatgaaaggaggactgggcccctagggttagctcttaaagattacttctaagtcatttcaagcattctgaatatttttcagttatgttcattcagactgatttgatatccatgggcaatattattttgaggtaacacttcataagtattaaaaaaaattactgtcccccccatttgaactatttaaaaagagagttaatggaatgtagagttacttaatttatgataaaattcatacc

SEQ ID NO: 12623 - DNA, 6070 bp, Homo sapiens
tagtatttcacatttcttttcttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggctgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaggctttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattacctttggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatctccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgtaataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatccttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctggtttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttatggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttattccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctgggggtgcctcccagttaggttgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaaaggaactccctgaccccttgcgcttcccaggtgaggcaatgcctcgacctgcttcggctcgcgcacggtgcacgcacacactggcctgcgcccactgtctggcactccctagtgagaagaacccggtacctcagatggaaatgcagaaatcacccgtcttctgcgtcgctcacgctgggagctgtagaccagagctgttcctattcggccatcttggctcctccccccctgacttggagttt

SEQ ID NO: 12624 - DNA, 4063 bp, Homo sapiens
ttttttttgcatcttgtaaggttttgtatattttttgtgcgttttttaaaatttattattatactttaagttttagggtacatgtgcacaatgtgcaggttagttacatatgtatacatgtgccatgctggtgtgctgcacccactaacccgtgatctagcattaggtatatctccaaatgctatcccttcccgctcccccaaccccacaacagtccccagagtgtgatgttccccttcctgtgtccatgtgttctcattgttcaattcccacctatgagtgagaatatgcagtgtttggtttttggttcttgcgatagtttactgagaatgatgatttccaatttcatccatgtcccaacaaaggacgtgaactcatcattttttatggctgcatagtattccatggtgtatatctgccatattttcttaatccagtctatcattgttagacatttgggttggttccaagtctttgctcttgtgaataatgccgcaataaatatacatgtgcatgtgtctttatagcagcatgacttatagtcctttgggtatatacccagtaatgggatggctgggtcaaatggtatttccagttctagatccctgaggaatcaccacactgacttccacaagggttgaactagtttacagtcccaccaacagtgtaaaagtgttcctatttctccacatcctctccagcacctgttgtttcttgactttttaatgattgatattctaactggtatgagatggtatctcattgtggttttgatttgcatttctctgatggccagtgatgatgagcattttttcttgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaagattttctcccattttgtaggttgcctgttcactctgatggtggtttcttttgctgtgcagaagctctttagtttaattagatcccatttgtcaattgtggcttttgttgccattgcttttggtgttttagacatgacgtccttgcccatgcctatgtcctgaatggtaatgcctaggtttccttctagagtttttatggttttaggtctaacgtttaagtctttaatccatcttgaattgatttttgtataaggtgtaaagaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccatggatctatatctctgttttggtaccagtaccatgctgttttggttactgtagccttgtggtatactttgaagtcaggtcgtgtgatgcctccagctttgttcttttggcttaggattaacttggcgatgtgggctctttgttggttccatatgaactttaaagtagttttttccaattctgtgaagaaagtcattggtagcttgatggggattgcattgaatctgtaaattaccttgggcagtatggccattttcacgatattgattcttcctacacatgagcatggaatgttctcccatttgtttgtatcctcttttatttccttgagcagtggtgtgtagttctccttgaagaggtccttcacgtcccttgtaagttggattcctaggtattttattctctttgaagcaattgtgaatgggagttcactcatgatttggctctctgtttgtctgttactggtgtataagaatgcttgtgatttttgtacattgattttgtatcctgagactttggtgaagttgcttatcagcttaaggagattttgggctgagaaaatggggttttccagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcccattcagtatgatattggctgtgggtttgtcatagatagctcttattattttgagatacatcccatcaatacttaatttattgagagtttttagcatgaagggttgttgaattttgtcgaaggccttttctgcatctattgagataatcatgtggtttttgtctttggttctgtttatatgctggattacatttattgattttcgtgtattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggtggtgtctctgctaggctttggtatcaggatgatgctggccttataaaatgagttagggaggattccctctttttctattcattggaatagtttcagaaggaatggtactagatcctccttgtacttctggtagaattcggctgtgaatccatctggtcctggactctttttggttcgtaagctattgattattgccacaatttcagctcctgttattggtctattcagagattcaacttcttcctggtttagtcttgggagagtgtatatgtcgaggaatttatccatttcttctagattttctactttatttgcggagaggtgtttgtagtattctctgatggtagtttgtatttctgtgggattggtggtgatatcccctttatcattttttattgcatctatttgattcttctctctttttttctttattagtcttgctagcagtctatcaattttgttgatcctttcaaaaaactagctcctagattcattaattttttgaagggttttttgtgtctctatttccttcagttctgctctgattttagttatttcttgccttctgctagcttttgaatgtgtttgctctggcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcagttttgagtgagattcttaattctgagttctagtttgattgcactgtggtctgagagatagtttgttataatttctgttcttttacatttgctgaggagagctttacttccaagtctgtggtcaattttggaataggtgtggtgtggtgctgaaaaaaatgtatattctgttgatttggggtggagagttctgtagatgtctattaggtccacttggtgcagagctgagttcaattcctgggtatccttgttgactttttgtctcgttgatctctctaatgttgacaatggggtgttaaagtctcccattattaatgtgtgggagtctaagtctctttgtaggtcgttcaggacttgctttatgaatctgggtgctcctgtattgggtgcatatatatttatgatagttagctcttcttgttgaattgatccctttaccattaagtaatggccttctttgtctcttttgatctttgttggtttaaagtctgttttatcagagactaggattgcaacccctgcatttttttgttttccatttgcttggtagatcttcctccatccttttattttgagcctatgtgtgtctctgcacatgagatgggtttcatgaatgcagcacactgatgggtcctgactctttatccaatttgccagtctgtgtcttttaattggagcatttagtccatttacatttaaagttaatat

SEQ ID NO: 12625 - DNA, 6177 bp, Homo sapiens
tttcagattttttttattattattatactttaagttttagggtacatgtgcacaatgtgcaggttagttacatatatatacatgtgccatgctggtgtgctgcacccattaactcgtcatttagcattaggtatatctcctaatgctatccctccccccttcccccaccccacaacagtccccagagtgtgatgttccccttcctgtgtccatgtgttctcattgttcaattcccatctatgagtgagaatatgcggtgtttggttttttgttcttgcgatagtttactgagaatgatgatttccaatttcacccatgtccctacaaaggacatgaactcatcattttttatggctgcatagtattccatggtgtatatgtgccacattttcttaatccagtctatcattgatggacatttgggttggttccaagtctttgctattgtgaatagtaccgcaataaacatatgtgtacatgtgtctttatagcagcatgattggtagtcctttgggtatatacccagtaatgggatggctgggtcaaatggtatttctagttctagatccctgaggaatcgccacactgacttccacaatggttgaactagtttacagttccaccaacagtgtaaaagtgttgctatttctccacatcctctccagcacctgttgtttcctgactttttgatgattgccattctaactggtgtgagatgatatctcattgtggttttgatttgcatttctctgatggccagtgatggtgagcattttttcatgtgttttttggctgcataaatgtcttcttttgagaagtgtctgttcatatcctttgcccactttttgatggggttgtttgtttttttcttgtaaatttgtttgagttcattgtagattctggatattaaccctttgtcagatgagtaggttgcgaaaattttctcccattttgtaggttgccgattcattctgatgatagtttcttttgctgtgcagaagctctttcatttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatctggaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatgtctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttaaagtcgttttttccaattctgtgaagaaagtcattggtagcttgatggggatggcatcgaatgtgtaaaataccttgggcagtatggccattttcacgatattgattcttcctacccatgagcatggaatgttcttccatttctttgtatcctcttttatttccttgagcagtggtttgtagttctccttgaagaggtccttcatgtcccttgtaggttggattcctaggtattttattctctttgaagcaattgtgaatgggagttcactcatgatttggctctctgtttgtttgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgccctttcagtatgatattggctatgggtttgtcatagatggctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatatcgaaccagccttgcatcccagggatgaagctctcttgatcatggtggataagctttttgatgtgctgctggatttggtttgccagtattttattgaggatttttgcatcaatgttcatcaaggatattggtctaaaattctcttctttggttgtgtctctgcccggctttggtatcaggatgatgctggcctcataaaatgagttagggaggattccctctttttctattgattggaatagtttcagaaggaagcataccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtccaggaatttatccatttcttctagattttccagtttatttgcgtagaggtgtttgtagtattctctgatggtagtttgtatttctgtgggattggtggtgacatccccgttatcattttttattgtgtctatttgattcttctctcttttcttctttattagtcttgctagtggtctatcaattttgttgatcctttcaaaaaaccagctcctggatgcattaattttttgaagggttttttgtgtctctatttccttcagttctgctctgattttagttatttcttgccttctgctagcttttgaatgtgtttgctcttgcttttctagttctttcaactgtgatgttagggtgtcaattttggatctttcctgctttctcttgtgggcatttagtgctataaatttccctctacacactgctttgaatgtgtcccagagattctggtatgttgtgtctttgttcttgttggtttcaaagaatatctttatttctgccttcatttcgttatgtacccagtagtcattcaggagcaggttgttcagtttccatgtagttgagcggttttgagtgagtttcttaatcctgagttccagtttgattgcactgtggtctgacagacagtttgttataatttctgttctcttatatttgctgaggagagcttcacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttaactttctgtctcgttgatctgtctaatgttgacagtggggtgttaaagtctcccattattattgtgtgggaatctaagtctctttgtaggtcactcaggacttgctttatgaatctggatgctcctgtattgggtgcatatatatttcggatagttagctcttcttgttgaattgatccctttaccattatgtaatggccttctttgtctcttttgatctttgttggtttaaagtctgttttatcagagactaagattgcaacccctgcctttttttgttttccatttgcttggtggatcttcctccatccttttattttgagcctatgtgtgtctctgcacctgagatgggtttcctgaatacagcacactgatgggtcttgactctttatccaatttgccagtctgtgtcttttgattggagcatttagtccatttacatttaaagttaatattgttatgtgtgaatttgatcctggcattatgatgttagctggttattttgctcgttagttgatgcagtttcttcctagctttgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggcaggatatgaaattctgggctgaaaattcttttctttaagaatgttgaatattggcccccactctcttctggcttgtagattttctgctgagagatctgctattagtctgatgggcctccctttgtgggtaacccgacctttctctctggctgcccttaacattttttccttcatttcaactttggtgaatctgacaattatgtttcttggagttgctcttctcgaggagtatctttgtggtgttctccgtatttcctgaatctgaatgttggcctgccttgctagattggggaagttctcctggataatatactgcacagtgttttccaacttggttccattctccccgtcactttcaggtacaccagtcagacttagatttggtcttttcacatagtcccatatttcttggaggctttgtttgtttctttttattcttttttctctcaacttcccttctcgcttcatttcattcatttgatcttccatcactgataccctttcttccagttgatcgcattggctcctgaggcttctgcattcttcacgtagttctcgagccttggctttcagctccatcagcgcctttaagcacttctctgtagtggttattctagttatacattcgtctaaatttttttcaaagtttttaacttcttcgcctttggtttgaatttcctcctgtagctcggagtagtttgatcgtctgaagccttcttctctcaactcatcaaagtcattctccatccagctttgttccgttgctggtgaggaactgcattcctttggaggaggagaggcattctgctttttagagtttccagtttttctgctctgtttcttccccatctttgtgtttttatctacttttggtctttgatgatggtgatgtacagatgggtttttggtgtggatgtcctttctgcttgttagttttccttctaacagacaggaccctcagctgcaggtctgttggagtttgctagaggtcccctccagaccctgtttgcctgggtatcagcagcggtggctgcagaacagcggattttcatgaacctcgaatgctgctgtgtgatcgttcttctggaatttttgtctcagaggagtacccagccgtgtgaggtgtcagtctgcccctactggggggtgcttcccggttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctctttgtctgtgccctgcccccagaggtggagcctacagaggcaggcaggcctccttgagctgtggtgggctccacccatttcgagcttcccggctgctttgtttacctaagcaagcctgggcaatggtgggcgcccctccctcagccttgctgccaccttgcagtttgatctcagactgctgtgctagcaatcagggggactccgtgggcataggaccctccaagccaggtgcgggatataatctcctggtgcgccgttttttaagcccgtcggaaaagtgcagtattagggtgggagtgacccgattttccaggtgctgtctgtcacccctttctttgactaggaaagggaactccccgaccccttgcgcttcccgagtgaggcaatgcctcgccctgcttcgtcttgcgcacggtgcgctgcacccactgtcctgcacccactgtctggtactccctagtgagatgaacctggtacctcagatggaaatgcagaaatcacccgtcttctgcgtcgctcatgctgggagctgtaaaccagagctgttcctattcggccatcttggctggcaatcccagatatttgt

SEQ ID NO: 12626 - DNA, 6032 bp, Homo sapiens
ttttttttttttattatactttaagttttagggtacatgtgcatattgtgcaggttagttacatatgtatacatgtgccatgctggtgcgctgcacccactaactcatcatctagcattaggtatatctcccaatgctatccctccccgctcccgccaccccaccacagtccccagagtgtgatattccccttcatgtgtccatgtgatctcattgttcaattcccacctatgagtgagaatatgcggtgtttgattttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacacacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaacagtgttcctatttctccacatcctctccagcacctgttgtttcctgactttttaatgattgccattctaactggtgtgagatgatatctcatagtggttttgatttgcatttctctgatggccagtgatgaagagcattttttcatgtgttttttggctgcataaatgtcttcttttgagaagtgtctgttcatgtccttcgcccactttttgatggggttgtttgtttttttcttgtaaatttgtttgagttaattgtagattctggatattagcgctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggattttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctgtttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaattcctaatttattgagagtttttagcatgaagggttgttgaattttgtcaaaggctctttctgcatctattgagataatcatgtggtttttgtctttggctctgtttatatgctggattacatttattgatttgcatatattgaaccagccttgcatcccagggatgaagcccacttgatcatggtggataagcttcttgatgtgctgctggattcggtttgccagtattttattgaggatttttgcatcaatgttcatcaaggatattggtctaaaattctctttgttcattgtgtcgttgtccagctttggtatcaggatgatgctggcctcataaaatgagttagggaggattccctctttttctattcattggaatagtttcagaaggaatggtaccagttcctccttgtacctctggtagaatttggctgtgaatccatctggtcctggactctttttggttggtaaactattgattattgccccaatttcagctcctgttattggtctattcagagattcaacttcttcctggtttagtcttgggagagtgtatgtgttgaggaatgtatccatttcttctagattttctagtttatttgagtagaggtgtttgtagtattctatgatggtagtttgtatttctgtgggatcagtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttcaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgatataatttctgttcttttacatttgctgaggagagctttacttccaagtatgtggtcaattttggaataggtgtggtgtggtgctgaaaaaaatgtatattctgttgatttggggtggagaattctgtagatgtctattaggtccgcttggtacagagctgagttcaattcctgggtattcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggggcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgtagagtgttttccaacttggttccattcttcccatcactttcaggtacaccaatcagatgtagatttggtcttttcacatagtcccatatttcttggaggctttgctcatttctttttattcttttttctctaaccttcccttctcgcttaatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgcgttcctttggaggaggagaggtgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcaggtctgttggaataccctgccgtgtgaggtatcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtcttttcgtttgtctgtgccctgcccccagaggtggagcccacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcccttcccaggtgaggcaatgcctcgccctgcttcggctcgcgcccagtgcgtgcacccactggcctgcgcccactgtctggcactccctagtgagatgaacccggtacctcagatggaaatgcagaaatcacccgtcttctgcgtcgctcacgctgggagctgtagaccagagctgttcctattcggccatcttggctcctcctcct

SEQ ID NO: 12627 - DNA, 6093 bp, Homo sapiens
acatgaatacatttattcacttcctctttttttttttttaaatttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcagttccaacctatgagtgacaatatacggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcatttgggtatatactatatggctgggtcaaatggtatttctagttctagatccctgaggaatcgccacactgacttccacaatggttgaactagtttacagtcccaccaacagtgtaaaagtgtccctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccattttttgatggggttgtttgtttttttcttgtaaatttgtttgagttcattgtagattctggatattagccctttgtcagatgagtaggttgcgaaaactttctcccatgttgtaggttgcctgttcactctgatggtagtttcttttgctgtgcagaagctctttagtttaattagatcccatttgtcaattttggcttttgttgccattgcttttggtgttttagacatgaagtccttgcccacgcctatgtcctggatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtttgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttttagttctccttgaagaggtccttcacgtcccttgtaagttggactcctaggtattttattctctttgaagcaattgtgaatgggagttcactcatgatttggctctctgtttgtctgttgttggtgtataagaatgcttgtgatttttgtacattgattttgcatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgtttccagtttttgcccattcagaatgatattggctgtgggtttgtcatagatagctcttattattttgaaatacgtcccatcaatacctaatttattgagagtttttagcatgaagggttgttgaattttgtcaagggctttttctgcatctattgagataatcatgtggtttttgtctttggctctgtttatatgctggattgcatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttattagcgtagaggtgtttgtagtattctctgatgatagtttgtatttctgtgggatcggtggtgatatcccctttatcattttttattgtgtctatttgattcttctctctttttttctttattagtcttgctagcggtctatcaattctgttgatcctttcaaagaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcattggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccttttaccattatgtaatggccttctttgtcttttttgatctttgttggtttaaagtctgttttatcagagactaggattgcaacccttgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagcttggctggatatgaaattctaggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattttccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgcttgggggtcaggggtcagggacccacttgaggaggcagtctgcccattctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctaacacattctttagaggaagatgaga

SEQ ID NO: 12628 - DNA, 6055 bp, Homo sapiens
ttgttttattttttatttttttattttttttatttttttaaattatactttaagttttagggtacatgtgcacattgtgcaggttagttacatatgtatacatgtgccatgctggtgtgctgcactcactaactcgtcgtctagcattagttgtatttcccaatgctatccctcccccctccccccaccccacaacagtccccagagtgtgatattccccttcctgtgtccatgggatctcattgttcaattcccacctatgagtgagaatatgcagtgtttggttttttgttcttgcggtagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattgtaactgatgtgagatggtatctcattgtggttttgatttgcatttctctgatggccagcgatgatgagcattttttcatgtgttttttggctgcataaatgtcttcttttgagaagtgtctgttcatgtcctttgcccactttttgatggggttgtttgttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgtcattgcttttggtgttttggacatgaagtccttgcccatgtctatgtcctgaatggtaatgcctaggttttcttctagggtttttatggttttaggtctaatgtctaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtaaccttgtagtatagtttgaagtcagatagtgtgatgcctccagctttgttcttttggcttaagattgacttggcgatgcaggctcttttttggttccatatgaactttcaagtagttttttccaattctgtgaagaaagtccttggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcttaggtattttattctctttgaagcaattgtgaatgggagttcactcatgatttggctctctgtttgtctgttgttggtgtataagaatgcttgtgatttttgtacattgattttgtatcgtgagactttgctgaagttgcttatcagcttaaggagattttgtgctgagacaatggggttttctagatatacaatcatgtcatctgcaaacagggacaatttgacttcctattttcctaattgaataccctttatttccttctcctgcctaattgccctggccagaatttccaacactgtgttgaataggagtggtgagagaaggcatccctgtcttgtgccagttttcaaagggaatgcttccagtttttgcccattcagtatgatattggctgtgggtttgtcatagatagctcttattattttgaaatacgtcccatcaatacctaatttgttgagagtttttagcatgaagggttgttgaattttgtcaaaggttttttctgcatctattgagataatcatgtggtttttgtctttggctctgtttatatgctggattacatttattgatttgcatatattgaaccagccttgcatgccagggatgaagcccacttgatcatggtggataagctttttgatgtgctgctggattcggtttgccagtattttattgagggtttttgcatcaatgttcatcaaggatattggtctataattctcttttttggttgtgtctctgcccagctttggtatcagaatgatgctggcctcacaaaatgagttagggaggattccctctttttctattgtttggaatagtttcagaaggaatggtactagtccctccttgtacctctggtagaattcagctgtgaatccatctggttctggactctttttggttggtaaactattgattattgccacaatttcagatcctgttattggtctattcagagattcaacttcttcctggtttagtcttaggagagtgtatgtgtcgaggaatttatccatttcttctagattttctagtttatttgcgtagaggtgtttgtagtattctctgatggtagtttgtatttctgtgggatcggtggtgatatcgcctttatcattttttattgcgtctatttgattcttccctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagttgaattgcactgtggtctgagagatagtttgttacaatttctgttattttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatctttggttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgcattgatccctttaccattatgtagtggccttctttgtctcttttgatctttgttggtttaaagtttgttttatcagagacgaggattgcaacccctgcctttttttgttttccatttgcttcgtagatcttcctccatccctttattttgagcctatgtgggtctctgcacgtgagatgggtttcctgaatacagcacactgatgggtcttgactctttatccaatttgccagtctgtgtcttttaattggagaatttggtccatttacatttaaagttaatactgttatgtgtgaatttgatcctgtcattatgatgttagctggttattttgctcgttagttgatgcagtttcttcctattctcgatggtctttacattttggcatgattttgcagcggctggtactggttgttcctttccatgtttagtgcttccttcaggagctcttttagggtaggcctggtggtgacaaaatctctcagcatttgcttgtctgtgaagtattttatttctccacttatgaagcttagtttggctggatatgaaattctgggttgaaaattcttttctttaagaatgttgaatattggcccccactctcttctggcttgtagggtttctgccgagagatccgctattagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccctgctagattgtggaagttctcctgaataatatcctgcagagtgttttccaacttggttccattctccccatcactttcaggtacaccaatcagacgtagatttggccttttcacatagtcccatatttcttggaggctttgttcatttctttttattcttttttctctaaacttcccttctcgcttcatttcattcatttcatcttccattgctgataccctttcttccatttgattgcatcggctcctgagtcttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagctcagaggaatttgatcgtgtgaagccttctctcagctcgtcaaagtcattctccatccagctttgttccgttgctggtgaggaactgcgttcctttggaggaggagaggcgctctgcgttgtagagtttccagtttttctgttctgttttttccccatctttgtggttttatctacttttggtctttgatgatggtgatgtacagatgggttttcggtgttgatgtcctttctctttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgctggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctctcccagcctcgctgccgccttgcagtttgatctcagactgctgtgctagcaatcagtgagattccgtgggcgtaggaccctccgagccaggtgcgggatataatctcgtggtgcaccgttttttaagccggtgtgaaaagcgcaatattcgggtgggagtgacccgattttccaggtgcgtccgtcacccctttctttgacttggaaagggaactccctgactccttgcacttcccaagtgaggcaatgcctcgccctgcttcggctcgcgcacggtgcgcgcacccactggcctgggcccactgtctggcactccctagtgagatgaaccgggtacctcagatggaaatgcagaaatcacccatcttctgcttccctcaggctgggagctgtagaccggagctgttcctattcggccatcttggctcctctctct

SEQ ID NO: 12629 - DNA, 5791 bp, Homo sapiens
tcttttttatttatttatttatttatttatttatttatttatttattattattataagttttagggtacgtgtgcacaatgtgcaggttagttacatatgtatacctgtgccatgctggtgtgctgcacccactaactcctcatctagcattaggtatatctcccaatgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagattgatgatttccaatttcatccatgtccctacaaaggacatgaactcatcattttttatggctgcatagtattccatggtgtatatgtgccacattttcttaatccagtctatcattgttgggcatgtgggttggttccaagtctttgctattgtgaatagtgccacaataaacatacgtgtgcatgtgtctttatagcagcatgatttatagtccttttggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttagtgattgccattctaactggtgtgagatggtatctcattgtggttttgatttgcatttctctgacggccagtgatggtgagcattttttcatgtgttttttggctgcataaatgtcttcttttgagaagcgtctgttcatgtcctttgcccactttttgatggggttgtttttttcttgtaaatttgtttgagttcattgtagattctggatattagccctttgtctgatgagtaggttgtgaaaattttctcccattttgtaagttgcctgttcactctggtggtagtttcttttgctgtgcagaagctctttagtttgattagatcccatttgtcaattttgacttttgttgccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaaggaagggatccagtttcagctttctacctatggctagccacttttctcagcaccatttattaaatagggaatcctttccccattgcttgtttttctcaggtttgtcaaagatcagatagttgtagatatgtgacattatttttgagggcaccattctgttccattgatctatatgtctgttttggtaccagtaccatgctgttttggttactgtagccttgtagtatagtttgaagtcaggtagtgtgatgcctccggctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttctttgtatcctcttttatttccttgagcagtggtttgtagttctccttgaagaggtccttcacatccctagtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacagtggagttttctagatatgcaatcatgttgtctgcaaacagcgacaatttgacttcctcttttcctaattgaataccctttatttccttctcctgcctaattgccctggccagaacttccaacactatgttgaataggagtggtgagagagggcaactctgtcttgtgccagttttgaaatggaatgcttccagtttttgcccattcagtatgatattggctgtgggtttgtcatagatagctcttattattttgaaatacgtcccatcaatacctaatttatttagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatactggtctaaaattatcttttttgtttgtgtctctgcccggctttggtatcaggatgatgctggcctcagaaaatgaattagggaggattccctctttttctattgattggaatagtttcagaaggaatggtaccagctcctccttgtacctctggtagaattcggctgtgaatccatctggtcctggactctttttggttggtaagctattgattattgccacaatttcagagcctgttattggtctattcagagagtcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgtgtctatttgattcttctctcttttcttctttatttgtcttgctagcggtctatcaattttgttgatcctttcaaaaaaccagctcctgggttcattaattttttgaagggttttttgtgtctctatttccttcagttctgctctgattttagttatttcttgccttctgctagcttttgtatgtgtttgctcttgcttttctagttcttttaattgtgatgttagggtgttaattttagatctttcctgctttctctcgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccgtgtagttgagcggttttgagtgagattcttaatcctgagttctagtttgattgcactgtgttctgagagatagtttgttataatttctgttttttttacatttgctgaggacagcttttcttcctcaaaatgtggtcaattttggaataggtgtggtgtggtgctgaaaaaaatgaatattctgttgatttggggtggagagttctgtagatgtctattaggtccgcttggtgcagagctgaggtcaattcatgggtatccttgttaactttctgtctcgttgatctgtctaatgttgacagtggggtgttaaagtctcctattattattgtgtgggagtctaagtctttttgtatgtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatctttttattttgagcctatgtgtgtctctgcacgtgagatgggtttcctgaatacagcacactgatgggtcgtgactctttatccaatttgccagtgtgtgtcttttaattggagcatttagtccatttacatttaaagttaatattgttatgtgtgaatttgatcctgtcgttatgatgttagctggttattttgctcgttagttgatgcagtttcttcctagtctctatggtctttacagtttggcatgattttacagcggctggtaccagttgttcctttccatgttttagcacttccttcaggagctcttttagggcaggcctggtggtgacaaaatctctcagcatttgcttgtctgtaaagtattttatttctccttcacttatgaagcttagtttggctggatatggaattctgggttgaaaattcttttctttgagaatgttgaatattgccccccactctcatctggcttgtagagttctgccgaaagatccactgttagtctgatgggcttccctttgagtgtaacccgacctttctctctggctgcccttaacatttttccttcatttcaactttggtgaatctgacaattatgtgtcttggagttgctcttcttgaggagtatctttgtggcgttctctgtatttcctgaatctgaatgttggcctgcctttctagattggggaagttctcctggataatatcctgcagagtgttttccaacttggttccattctccccgtcactttcaggtacatcaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcaccggctcctgaggcttctgcattcttcacgtagttctcgagccttggttttcagctccatcagctcctttaagcacttctctgtattggttattctagttatacattcttctaaatttttttcaaagctttcaacttctttgcctttggtttgaatgtcctcccgtagcttggagtaatttgatcatctgaagccttcttctctcagttcgtcaaagtcatcctccgtccagctttgttccgttgctggtgaggaactgcgttcctttggaggaggagaggtgctctgctttttagagtttccagtttttctgctctgttttttccccatttttgtggttttatctacttttggtctttgatgatggtgatgtacagatgggtttttggtgtggatgtcctttctgtttgttagttttccttctaacagacaggaccctcagctgcaggtctgttggagtactgggccctgtgaggtgtcagtctgcccctgctggggggtgcctcccagttaggctgctcaggggtcaggggtcagggacccacttgaggaggcagtctgcccgttctcagatctccagttgcatgctgggagaaccactgctctcttcaaagctgtcagacagggacatttaagtctgcagaggtaactgctgtctttttgtttgtctgtgccctgcccccagaggtggagcctacagaggcaggcaggcctccttgagctgtggtgggctccacccagctcgcacttcccggatgctttgtttacctaagcaagcctgggcaatggcgggcgcccctcccccagcctcgctgccgccttgcagtttgatctcagactgctgtgctaggaatcagcgagattccttgggcataggaccctccgagccaggtgcaggatgtaatctcctggtgtgtggttttttaagcccgtcggaatagcgcagtatttgggtgggagtgaccc

SEQ ID NO: 12630 - DNA, 6948 bp, Homo sapiens
tcccaaagtgctgggattacaggcgggagccaccgcgcctggccccaaaattccttttttaaaccaatattctagtggcgcactattctccaacaattcccacattaaattgttgcatgacccctgtagtaaaaagcattactcagatctgacaaactcagacacccccagtttttacaaatttagtgacaccccctcaaagctaacagcattatcatataattgggaagagttgttcctaagagagaacatgagttccagagatgtataagaactatctatatgtgtaatctgtactgccagttagccccagaaatgccctggacacaaaatctgtccaagctgaaaacaaaatttgccatctctagcacatcattctgattcaggtggtctttactacaggacttttttcgtgtaacccttagcaagttgtttgaggctaagaagcgaagacctgagtctgaagcaaataaaagttatatacaacttttactgacatttttgaacacggatagtattaaaccaagggtcactgtgccaggaggggaaaaattaagtactgtaattatatatattgagctatcccaaggataaaggaatcactgtttactatgatagtgatctggaggtttaaaaaacaaaaaacaaaaacaaaacaaagaaaaccactcaaattgactgggccagaaatcttatttgctcttccttctccccaacagattattttgagttagttctatctaaggaatttacacccttgttcatttaagtcaccctaaagtggagtatttactcaatattggttactttctcactggagtattgacattttattttatttatttatttatttatttgcaatctatcacatgatctttaattaactaacagtacctcagggtaaatccaaaagctgttcttttttttttttttaatactttaagttttagggtacatgtgcacaatgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcagttcccacctatgagtgagaatatgcggtatttcgttttttgttcttgctatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctctgggtatatacccagtaatgggatggctgggtcaaatggtatttctagttctaggtccctgaggaatcgccacactgacttccacaatggttgaactagtttacagtcccaccaacagtgtaaaagtgttcctatttctccacatcctctccagcacctgttgtttcctgacttttttatgattgccactctaactggtgtgagatggtatgtcattgtggttttgatttgcatttctctgatggccagtgatggtgagcattttttcatgtgttttttggctgcataaatgtcttcttttgagaagtgtctgttcatgtcctttgcccactttttgatggggttgtttgtttgtttcttgtaaatttgtttgagttctttgtagattctggatattagccctttgtcagatgagtaggttgcaaaaattttctcccattttgtaggttgcctgttcactctgatggtagtttcttttgccgtgcagaagctctttagtttaattagatcccatttgtcaattttggcttttgtagccattgcttttggtgttttagacatgaagtccttgcccatgcctatgtcctgaatgataatgcctaggttttcttctagggtttttatggttttaggtctaacatttaagtctttaatctatctttaattgatttttgtataaggtgtaaggaagggatccagtttcagctttctacatatggctagccagtttttccagcaccatttattaaatagggaatcctttccccattgcttgtttttctcaggtttgtcaaagatcagatagttgtagatatgcagtgttatttctgagggctctgttctgttccattgatctatatctctgttttggtaccactaccatgctgttttggttactgtagccttgtagtatagtttgaagtcaggtagtgtgatgcctccagctttgttcttttggctcaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtagtttgtagttctccttgaagaggtccttcacatcccttgtaagttggattcctaggtattttattctctttgaagcaattgtgaatgggagttcactcacgatttggctctctgtttgtctgttgttggtgtataagaatgcttgtgatttttgtacattgattttgtatcctgagactttgctgaagttgcttatcagcttaaggagattttgagctgagacaatggggttttgtagatatacggtcatgtcgtctgcaaacagggacaatttgacttcctcttttcctaattgaatactctttatttccttctcctgcctaattgtcctggccagaatttccaacactatgttgaataggagtggtgagagagggcatccctgtcttgtgccagttttcaaagggaatgcttccagtttttgcccattcagtatgatattggctgtgggtctgtcatagatagctcttatgattttgagatacgtcccatcaatacctaatttattgagagtttttagcatgaagggttgttgaattttatcaaaggccttttctgcatctattgagataatcatgtggtttttgtctttggttctgtttatatgctggattacatttattgatttgcgtatattgaaccagcccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtttctgcccggctttggtatcaggatgatgctggcctcataaaatgagttaggaaggattccctctttttctattgattggaatagtttcagaaggaatggtaccagttcctccttgtacctctggtagaatttggctgtgaatccatctggtcctggactctttttcgttggtaagctattgattattgccacaatttcagctcctgttattggtctattcagagattcaacttcttcctggtttagtcttgggagagtgtatgtgtcgaggaatttatccatttcttctagattttctggtttatttgcgtagacgtgtttgtagtattctctgatggtagtttgtatttctgtgggattggtggtgatatcccttttatcattttttattgcatctatttgattcttctctctttttttctttattagtcttgctagcggtctatcaattttgttgatcctttcaaaaaaccagctcctggattcgttaattttttgaagggttttttgtgtctctatttccttcagttctgctctgattttagttatttcttgccttctgctagcttttgaatgtgtttgcttttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggccaattttggaataggtgtggtgtggtgctgaaaaaaacgtatattctgttgatttggggtggagagttctgtagatgtctattaggtccgcttggtggagagctgagttcaattcctgggtattcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatcaacaaggccttaattacttaattgatcattaagtaatggccttcgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccgtttgttcctgtccatgtttagtgcttccttcaggagctcttttagggcaggcctggtggtgacaaaatctctcagcatttgcttgtctgtaaagtattttatttctccttcacttatgaagcttaatttggctggatatgaaattctgggttgaaaattcttttctttaagaatgttgaatattggcccccactctcttctggcttgtagagtttatgccgagagatctgctgttagcctgatgggcttccctttcagggtaacccacctttctctctggctgcccttaacattttttccttcatttcaactttggtgaatctgacaattatgtgtcttggtgttgctcttctcgaggagtatctttgtggcattctctgtatttcctgaatctgaatgttggcctgccttgctagattggggaagttctcctggataatatcctgtagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccatcgctgataccctttcttccagttgattgcatcggctcctgaggcttctgcattcttcacgtagttcttgagccttggctttcagctccatcagctcctttaagcacttctctgtattggttattgtagttatacattcttctaaatttttttcaaagttttcaacttctttgcctttggtttgaatgtcctcccgtagctcagagtaatttgatcgtctgaagccttcttctctcagctcgtcaaagtcattctccgtccagctttgttccgttgctggtgaggaactgtgttcctttggaggaggagaggtgctctgctttttagagtttgcagtttttctgctctgttttttccccatctttgtggttctatctacttttggttttcgatgatggtgatgtacagatgggtttttggtgtggacgtcctttctgtttgttagttttccttctaacagacaggaccctcagctgcaggtctgttggagtacctggccgtgtgaggtgtcagtctgcccctgctgggggttgcctcccagttaggctgcttgggggtcaggggtcagggacccacttgaggaggcagtctggcagttctcagatctccagctgcgtgctaggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcaggcacccctcccccagcctcgctgccgccttgcagtttgatctcagactgctgtgctagcaatcagcgagactccgtgggtgtaggaccctccgagccaggtgcgggatataatctcctggtgcgctgttttttaagcccgtcggaaaagcgaagttttcgggtgggagtgacccgattttccaggtgctgtctgtcaccactttctttgactaggaaagggaactccctgaccccttgcgcttcccgagtgaggcaatgcctcgccctgcttcggctcgtgcacagtgcgcgcacccactgacctgcgcccactgtctggcactccctattgagatgaaccgggtacctcagatggaaatgcagaaatcacccgtcttctgcgtcactcatgctgggagctgtcgactggagctgttcctattcgg

SEQ ID NO: 12631 - DNA, 6040 bp, Homo sapiens
atgtttttttttctttttttttattatactttaagttttagggtacatgtgcacaatgtgcaggttaattacatatgtatacatgtgccatgctggtgcgctgcacccactaactcgtcatctagccttaggtatatctcccaatgctatccctccccgctccccccaccccaccacagtccccagagtgtgatattccccttcatgtgtccatgtgatctcattgttcaattcccacctatgagtgagaatgtgcggtgcttggttttttgttcttgcgatagtttactgagaatgatgatttccaatttcatccatgtccctacaaaggacatgaactcatcattttttatggctgcatagtattccatggtgtatatgtgccacattttctgaatccagtctatcattgttggacatttggcttggttccaagtctttgctattgtgaataataccgcaataaacatacgtgtgcatgtgtctttatagcagcatgatttatagtcatttgggtatatacccagtaatgggatggctgggtcaaatggtatttctagttctagatccctgagtaatcgccacactgacttccacaatggttgaaccagtttacagtcccaccaacagtgtaaaagtgttcctatttctccacatcctctccagcacctgttgtttcctgactttttaatgatcaccattctaaccggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctctcatgttgtaggttgcctgttcactctgatggtagtttcttttgctgtgcagaagctctttagtttaattagatcccatttgtcaattttggcttttgttgccattgcttttggtgttttggacatgaagtccttgcccatgcctgtgtcctgaatggtaatgcctaggttttcttctagggttgttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttcttccaattctgtgaagaaagtcattggtagcttgatgggaatggcattgaatctgtaaattaccttgggcagtatggccattttcacgatattgattcttcctacccatgagcatggaatgttcttctatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatctctgtcttgtgccagttttcaaagggaatgcttccagtttttgcccattcagtatgatattggctgtgggtttgtcatagatagctcttattattttgaaatacgtcccatcaatacctaatttattgagtttttagcatgaagggttgttgaattttgtcaaaggctttttctgcatctattgagataatcatgtggtttttgtctttggctctgtttatatgctggattacatttattgatttgtgtctattgaaccagccttgcatcccagggatgaagcccacttgatcatggtggataagctttttgatgtgctgctggattcggtttgccagtattttattgaggatttttgcatcaatgttcatcaaagatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagatattcaacttcttcctggtttagtcttgggagagtgtatgtgtcgaggaatgtatccatttcttctagattttcttgtttatttgcctagaggtgtttgtagtattctctgatggtagtttgtatttctgtgggatcagtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttgtagttcttttaattgtgatgttagggtgtcaattttggatctttcctgctttctcctgtgggcatttagtgctataaatttccctctacacactgctttgaatgcgtcccagagattctggtatgttgtgtctttgttctcgttggtttcaatgaacatctttatttctgccttcatttcattatgtatccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactctgtggtcaattttggaataggtgcggtgtggtgctgaaaaaaatgtatattctgttgatttggggtggagagttctgtagatgtctattaggtccgcttggtacagagctgaattcaattcctgggtatccttgttgactttctgtctcattgatctgtttaatgttgacagtggggtgttaaagtctcccattattaatgtgtgggagtctaagtctctttgtaggtcactcaggacttgctttatgaatctgggtgctcctgtattggttgcatatatatttaggatagttagctcctcttgttgaattgatccctttaccattatgtaatggccttctttgtctcttctgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacacttatgggtcttgactctttatccaacttgccagtctgtgtcttttaactggagaatttagtccatttacatttaaagttaatattgttatgtgtgaatttgatcctgtcattatgatgttagctggtgattttgctcattagttgatgcagtttcttcctagtctcgatggtctttacgttttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttattttggctggatatggaattctgggttgaaaattcttttctttaagaatgttgaatactggcccccactctcttctggcttgtagggtttctgctgagagatccactgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctatagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtaggtcagagtaatttgatcgtctgaagccttcttctctcagctcgtcaaagtcattctccatccagctttgttccgttgctggtgaggaactgcgttcctttggaggaggagaggtgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcaggtctgttggaataccctgccgtgtgaggtgtcagtgtgcccctgcttgggggtgcctcccagttaggctgctcggaggtcaggggtcagggacccacttgaggaggcagtctgcccgttgtcagatctccagctgcgtgctgggagaaccactgctctcttcaaagctgtcagacagggacatttaagtctgcagaggttactgctgtctttttgtttatctgtgccctgcccccagaggtggagcctacagaggcaggcaggcctccttgagctctggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggtgtaggaccctccgagccaggtgtgggatatagtcttgtgctgcgccgttttttaagccggtctgaaaaacgcaatattagggtgggagtgacccgattttccaggtgcgtctgtcacccctttctttgactcggaaagggaactccctgaccccttgcgcttcccagtgaggcaatgcctcgccctgcttcggctcgtgctcggtgcacgcacccactggcctgcgcccactgtctggcactccctagtgagatgaacccggtacctcagatggaaatgcagaaatcacccgttttctgcgtcgctcacgctgggagctgtagaccggagctgttcttattcggccatcttggctcctcctccc

SEQ ID NO: 12632 - DNA, 5363 bp, Homo sapiens
tttttaaaatttgtattttattattatacttcaagttttagggtacatgtgcacaacatgcaggtttcttacatatgtatacatgtgccatgttggtgtgctgcacccattaactcgtcatttatcattaggtatatctcctaatgctatccctcccccctccccccaccccacaactgtccctggtgtgtgatgttccccttcctgtgtccatgtgttatcattgttcaattcccacctatgagtgagaacatgtggtgtttggttttttgtccttgcgatggtttgctgagaatgatagtttccagtttcatccatgtccctacaaaggacatgaactcatcattttttatggctgcatagtattccatggtgtatatgtgccacattttcttaatccagtctatcgttgttggacatttaggttggttccaagtctttgctattgtgaatagtgccgctgtaaacatacatgtgcatgtgtctttatagcagcatgatttataatcctttgggtatatacccagtaatgggatgactgggtcaaatggtattgctagttctaggtccctgaggaatcgccacactgacttccacaatggttgaactagtttacagtcccaccaacagtgtaaaagtgttcctatttctccacatcctctccagcacctgttgtttcctgactttttaatgattgccattccaactggtgtgagatggtatctcattgtggttttgatttgcatttctctgatggccagtgatgatgagcattttttcatgtgttttttggctgcataaatgtcttcttttgagaagtgtctgttcatgttcttcgcccactttttgatgaggttgtttgtttttttcttgtaaatttgtttgagttcattgtagattctgaatattagccctttgtcagatgagtaggttgcaaaaattttctcccattctgtaggttgcctgttcactctgatggtcgtttcttttgctgtgcagaagctctttagtttaattagatcccatttgtcaattttggcttttgttgccattgcttttggtgttttagacatgacgtccttgcccatgcctatgtcctgaatggtattgcctaggttttcttctagggtttttatggttttagggctaacgtttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgtggcattatttctgagggctgtgttctgttccattgatctatatctctgttttggtaccagtaccatgctgttttggttcctgtagccttgtagtatagtttgaagtcaggtagcatgatgcctccagctttgttcttttggtttaggattgacttggcgatgcaggctcttttttggttccatatgaactttaaagtagttttttccaattctgtgaagaaagtcattggtagcttgattgggatggcattgaatctataaattaccttgggcagtatggccattttcacgatattgattcttcctacccatgagcatggaatgttcttccacttgtttgtatcctcttttatttcattgagcagtggtttgtagttcttcttgaagaggtccttcacatcccttgtaagttggattcctaggtattttattctctttgaagcaattgtgaatgggagttcactcatgatttggcctctgtttgtctgttattggtgtataagagtgcttgtgatttttgtacattgatttttgtatcctgagactttgctgaagttgcttatcagcttgaggagatttggggctgagacgatggggttttctagatatacaatcatgtcatctgcaagcagggacaatttgacttcctcttttcctaatcgaatgccctttatttccttctcctgcctgactgccctggccagaacttccaacactatgttgaataggagtggtgagagagggcatccctgtcttgtgccagttttcaaagagaatgcttccagtttttgcccattcagtatgatatcggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttacatcgatgttcatcagggatattggtctgaaattctcttttttggttgtgtctctgtcaggctttggtatcaggatgatgctggcctcataaaatgagttagggaggattccctctttttctattgattggaatagtttcagaaggattggtaccagctcctctttgtacctctggtagaattcggctgtgaatccatctggtcctggagtttttttggttggtaagctattgattatttcctcaatttcagagcctgttattggtctattcagaggttcaacttcttcctggtttagtcttgggaggatgtatgtgtcgaggaatttatccatttcttctagattttctagtttatttgcgtagaggtgtttataatattctctgatggtagtttgtatttctgtgggattggtggtgatatcccctttatcattttttattgcatctatttgattcttctctcttttcttctttattagtcttgctagtggtctatcaattttgttgatcttttcaaaaaaccagctcctggattcattaatgttttgaagggctttttgtgtctctgtttccttcagttatgctctgatcttagttatttcttgccttctgctagcttttgaatgtgtttgctctcgcttttctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcacttcattatttacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggagtaggtgtagtgtggtgctgaaaagaatgtatattctgttgatttggggtggagagttctgtagatgtctattaggtccacttggtgcagagctgagttcaattcctgggtatccttgttaacttcctgtctcgttgatctgtctaatgttgacagtggggtgttaaagtctcccattattattgggtgggagtgtaagtctctttgtaggtcattaaggacttgctttatgaatctgggtgctcctgtattgggtgcatatatatttaggatagttagttcttcttgttgaattgatccctttatcattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatatagcacaatgatgggtcttgactctttatccaatttgccagtctgtgtcttttaattggagcatttagcccatttacatttaaagttaatattgttatgtgtgaatttgatcctgtcattatgatgttagctgattattttgcccgttagttgatgcagtttcttcctagccttgatgctctttacaatttggcatgtttttgcagtggctggtaccagttgttcctttccatgtttagtgcttccttcaggagctcttttagggcagggctggtggtgacaaaatctctcagcatttgcttgtctgtaaagtgttttatttctccttcacttatgaagcttagtttggctggatatgaaattctgggttgaaaattcttttctttaagaatgttgaatattggtccccactctcttctggctggtagagtttctgcagagagatcagctgttagtctgatgggcttccctttgtgggtaacctgacctttctctctggctgccctgaacatttgtttcttcatttcaactttggtgaatctgacaattatgtgtcttggagttgctcttctcaaggactatctttgtggcattctctgtatttcctgaatctgaatgttggcctgccttgctagattggggaacttctcttggataatatcctacagagtgttttccaacttggttccattctccccgtcactttcaggtacaccaatcagatgtagatttggtcttttcacatagtcccatatttcttggaggctttgttcgtttctttttattcttttttctctaaacttctcttctcgcttcatttcattcatttcgtcttccatcactgataccctttcttccagtttatcgcatcggctactgaggcttctgcattcgtcacgtagctctcgtgccttggttttcagctccatcaggtcctttaaggacttctctgcattggttattctagttatccattcatctaattttttttcaaagccttttaacttctttgccattggtttgaatttcctcctgtagctcggagtagtttgatcgtctgaaaccttcttctctcaacttgtcaaagtcattctgcgtccagctttgttccgttgctagtgaggagctgcgttcctttggaggaggagaggtgctctgatttttagagtttccagttttcctgctctgttttttcccccatctttgtggttttatctacttttggtctttgaaggtggtgacgtacagatgggtttttggtgtggatgtcctttctgtttgttagttttccttctaacagagaggaccctcagctgcaggtctgttggagtttgctagaggtccactccagactctgtttgccttggtgtcagcagcggtggctgcagaagagtggatattggtgaaccgcaaatgctgctgcctga

SEQ ID NO: 12633 - DNA, 6034 bp, Homo sapiens
attattattattattttttttaaattatactttaagttttagggtacatgtgcacattgtgcaggttagttacatatgtatacgtgtgccatgctggtgcgctgcacccactaactcatcatctagcattaggtatatctcccaatgctatccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttgatccagtctatcattgttggacatttgggttggttccaagtctttgctattgtgaataatgccgcaataaacatacgtgtgcatgtgtctttatagcagcgtgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgattgccattctaactggtgtgagatgatatctcatagtggttttgatttgcatttctctgatggccagtgatgatgagcattttttcatgtgtctgttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcccccactgtgcagaagctctttagtttaattagatcccatttgtcaattttggctttggttgccattgcttttggtgttttggacatgaagtccttgcccacgcctatgtcctgaatggtaatgcctaggtttccttctagggtttttatggttttaggtctaacgtttaaatctttaatccatcttgaattgatttttgtataaggtgtaaggaagggatccggtttcagctttctacatatggctagccagttttcccagcaccatttattaaataggaaatcctttccccattgcttgtttttctcagatttgtcaaagatcaggtagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttttcttttggcttaggattgacttggtgatgcgggctcttttttggttccatatgaactttaaagtcgttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatacttgtgatttttgtacattgattttgtatcctgagactttgctgaagttgcttattagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtgatttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactcttgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtatatttgattcttctctctttttttctttattagtcttgctagcggtctatcaattttgttgatcctttcaaaaaaccagctcctggattcactgattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagtaggttgttcagtttccatgtagttgagtggctttgagtgagattcttaatcctgagttctagtttgattgcgctgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaggtctctttgtaggtcactcaggacttgctttatgaatctgggtgctcctgtattggctgcatatatatttaggatagttagctcctcttgttgaattgatccctttaccattatgtaatggccttctttgtctcttttgatctttgttgatttaaagtctgttttatcagagactaggattgcaacccctgcctttttttgttttccatttgcttggtagatcttcctccatccttttattttgagcctatgtgtgtctctgcacatgagatgggtctcctgaatacagcacactgatgggtcttgactctttatccaatttgccagtctgtgtcttttaattggagaatttagtccatttacatttaaagttagtgttgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcacttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgcccttaacattttttccttcatttcaactttggtgaatctgacaattatgtgtcttggagttgctcttcccgaggagtatctttgtggcgttctctgtatttcctgaatctgaacgttggcctgccttgctagattggggaagttctcctggataatatcctgcagagtgttttccaacttggttgcattctccccatcactttcaggtacaccaatcagacgtagatttggtcttttcacatcgtcccacatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcggggatcaggggtcagggacccacttgaggaggcagtctgcctgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccggctgctttgtttacctaatcaagcctgggcaatggcgggcgcccctcccccagcctggctgccgccttgcagtttgatctcagactgctgtgctagcaatcagcgagatgccgtgggcgtaggaccctccgagccaggtgtgggatatagtctcgtcgtgcgccgttttttaagccggtctgaaaagcgcaatattcgggtgggagtgacccgattttccaggtgcgtccgtcacccctttctttgactcggaaagggaactccctgaccccttgcgcttcccaggtgagggaatgcctcgccctgctttggcttgcgcacggtgcgcgcacccactggcctgcgcccactgtctggcactccctagtgagatgaacccggtacctcagatggaaatgcagaaatcacccgtcttctgtgtcgctcacgctgggagctgtagaccggagctgttcctatttggccatcttggctcctcccctat

SEQ ID NO: 12634 - DNA, 11387 bp, Homo sapiens
tttttgtctttatttatttatttatttttattacactttaagttttagggtacatgtgcacaacgtgcaggtttgttacatatatatacatgtgccatgttggtgtgctgcacccattaacttgtcatttaacattaggtatatctcccaatgctacccctccaccctcccccaccacacaacaggccctggtgtgtgatgttccccttcctgtgtccaagtgttctcactgttcaattcccacctatgagtgagaacatgtggtgtttggttttttgtccttgtgatagtttgctgagaatgatggtttccagcttcatccatgtccctacaaaggacatgaactcatcattttttatggctgcatagtattccatggtgtatatgtgccacattttcttttctttttttttttttaattatactttaagttttagggtacatgtgcacattgtgcaggttagttacatatctatacatgtgccatgctggtgcgctgcacccactaactcgtcgtctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatctccctacaaaggacatgaactcatcattttttatggctgcatagtattccatggtgtatatgagccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttgttaatgattgacattctaactggtgtgagatgatatctcatagtggttttgatttgcatttctctgatggccagtgatgatgagcattttttcatgtgttttttggctgcataaatgtcttcttttgagaagtgtctgttcatgtccttcgcccaatttttgatggggttgtttgtttttttcttgtaaatttgtttgagttcattgtagattctggatattagccctttgtcagatgagtaggttgcgaaaattttcttccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacttttaaatctttaatccatcttgaattgatttttatataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaggtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacatggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctcgattacatttattgatttgcgtatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttactagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacttctttatttctgccttcatttcgttatgtacccagtagtcattcaggagcaggttgttcagtttccatgtagttgagcggctttgagtgagattctttatcctgagttctagtttgattgcacggtggtctgagagatagtttgttataatttctgttcttttccatttgctgaggagtgctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatccttgttggtttaaagtctgttttatcagagactaggattgcaacccctgcctttttttgttttccacttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggttgttcctttccatgtttagtgcttccttcaggacctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctgtataatatcctgcagagtgttttccaacttggttccattctccgcatcactttcaggtacaccaatcagacatagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgagccttggttttcagctccatcaactcctttaagcacttctctgtattgcttattctagttatacattcttctaaattttttccaagttttcaacttctttgcctttggtttgaatgtcctcccgtagctcagagtaatttgatcgtctgaagtcttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatgttgatgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgggggtcaggggtcagggacccacttgaggaggcagtctgcccggtctcagatctccagctgcgtgctgggagaaccactgctctcttcaaagctgttagacagggacatttaagtctgcagaggttactgctgtctttttgtttgtctgtgccctgcccccagaggtggagcctacagaggcaggcaggcctccttgagctgtggtgggctccacccagttcgagcttgccggctgctttgtttacctaagcaagcctgggcaatggcgggcgcccctcccccagcctcgctgccgccttgcagtttgatctcagactgctgtgctagcaatcagcgagactccgtgggcgtaggaccctccgagccaggtgtgggatatagtctcgtggtgtgccgttttttaagccggtctgaaaagcgcaatattcgggtgggagtgacccaattttccaggtgcgtccgtcacccctttctttgactcggaaagggaactccctgaccccttgcacttcccaggtgaggcaatgcctcgccctgcttcggctcgcgcacagtgcgcgcacctactggcctgcgcccactgtctggcactccccagtgagatgaacccggtacctcagatggaaatgcagaaatcacccgtcttccgcgtcgctcacgctgggagctgtagaccggagctgttcctattcggccatcttggctcctctctccgtgccacattttcttaatccagtctatcattgttggacatgtgggttggttccaagtctttgctattgtgaatagtgccacaataaacatacgtgtgcatgtgtctttatagcagcatgatttataatcctttgggatatacccagtaatgggatggctgggtcaaatggtatctctagttctagatccctgaggaattgccacactgacttccacaatggtagaactagtttacagtcccaccaacagggtaaaagtgttcctatttctccacatcctctccagcacctgttatttcctgactttttaatgatcaccattctaactggtgtgagatggtatctcattgtggttttggctgcataaatgtcttcttttgagatgtggctgttcatgtcctttgcccactttttgatggggttatttgtttttttcttgtaaatttgtttgagttcattgtagattctggatattagccctttgtcagatgagtagattgcaaaaattttctcccattctgtaggttgcctgttcactccgatgatagtttcttttcctgtgcagaagctctttagtttaattagatcccatttgtcaattttgacttttgttgccattgcctttggtgttttagacatgaagtccttgcccatacctatgtcctgaatggtattgtgtaggttttcttctagggtttttatggttttaggtctaacatttaaatctttaatccatcgtgaattaattttagtataaggtgtaaggaagggatccagtttcagctttctacatatggctagccagttttcccagcaccatttattaaatagggaatcttttccccatttcttttttttgtcaggtttgtcaaagatcagatggttctagatatgtggcattatttctgagggctgtgttctgttccattggtctatatctctgttttggtaccagtaccatgctgttttggttactgtagccttgtagtatagtttgaagtcaggtagcttgatgcctccagctttgttcttttggcttaggattgacttggcaaagcaggctgttttttggttccatatgaactttaaagtagttttttccaattctgtgaagaaggtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctaaagttgcttatcagcttaaggagattttgggctgagacgatggggttttctagatatacaatcatgtcatctgcaaacagggacaatttgactacctcttttcctaattgaatgccctttatttctttctcgtgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatacctaatttatagagagtttttagcatgaagcgttgttgaattttgtcaagggccttttctgcatctattgagataatcatgtggtttttgtctttggctctgtttatttgatggattacatttattgatttgcatatggtgaaccagccttgcatcccagggatgaagcccacttgatcatggtagataagctttttgatgtgctgctggattcggtttgccagtattttattgaggatttttgcatcaatgttcattagggatattggtctaaaattctctttttttctgttgtgtctctgcccggctttggtatcaggatgatgctggcctcataaaatgagttagggaggattctctctttttctattgattggaatagtttcagaaggaatgataccagctcctccttgtacctctggtagaattttgctatgaatccatgtggtcctggactttttttggttggtaagctattaattattgcctcaatttcagagcctgttattggtctattcagagattcaacttcttcctggtttagtcttgggagagtgtatgtgtcgaggaatttatccatttcttccatattttctagtttatttgcatagaggtggttaaagtattctctgatggtagtttgtatttttgtgggattggtggtgatatcccctttatcatttttcattgcatctatttgattcttctttcttttcttctttattcgtcttgctagtggtctgtcaattttgttgatcttttcaaaaaaccagttcctggattcactgattttttgaagggtttttgtgtctctatttctttcagttctgctctgattttagttatttcttgccttctgctagcttttgaatgtgtttgctcttgcttctctagttcttttaattatgatgttagggtgtcaattttagacctttcctgctttctcttgtgggcatttagtgctataaatttccctctacacactgctttgaatgtgtcccagagattctggtatgttgtgtctttgttctcgttggtttcaaagaacttctttatttctgccttcattttgttatgtacccagtagtcattcaggagcaggttgttcagtttccatgtagttgagtggttttgagtgagtttcttaatcctgagttctagtttgattgcactgtggtctgagagacagtttgttataatttctgttcttttccatttgctgaggagtgctttacttccaactatgtggtcaattttggaataggtgtggtgtggtgctgaaaaaaatgtatattctgttgatttggggtggagagttctgtagatgtctattaggtctgcttggtgcagagctgagttcaattcctggatatctttgttaactttctgtctcgttgatctgtctaacgttgacagtggggcgttaaagtctcccatgattattttgtgggagtctaactctctttgtaggtcactcaggacttgctttatgaatctaggtgctcctgtattgggcgcatatatatttaggatagttagctcttcttgttgaattgatccctttaccattatgtaatggccttctttgtctcttttgatctttgttggtttaaagtctgttttatcagagactaggattgcaacccctgccttttttgttttccatttgcttggtagatcttcctccatctttttattttgagcctatgagtgtctctgcacgtgagatgggtttcctgaatacagcacacagatgggtcttgactctttatccaatttccaatctgtgtcttttaattggagcatttagcccatttacatttaaggttaatattgttatgtgtgaatttcatcctgtcattatgatgttagctggttattttgcttgtttattgatgcagtttcttcctagcctcgatagtctttagaatttggcatgtttttgcagtggctggtaccagttgctcctttccatgtttagtgcttccttcaggagctcttttagggcaatcctggtgctgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggttttggccgagagatcagctgttagtctgatgggcttccctttgtgggtaacccaacctttctctctggctgcccttaacattttttccttcatttcaactttggtgaatctgacaattatgtgtcttggagttgctcttctccaggagtatctttatggcgttctctgtatttcctgaatttgaatgttggcctgccttgctagattggggaagttctcctggataatatcctgcagagtgttttccaacttggttccattctcccgtcactttcaggtacaccaatcagaggtagatttggtcttttcacatagtcccatatttcttggaggctttgttcgtttcttttcattctcttttctctaaatttctcttcttgcttcatttcattcatttgatcttccatcactgataccctttcttccagttgatcgaatcggctactgagacttgtgcattcatcacgtatttcttgtgccgtggttttcagctccatcaggtcctttaaggacttctctgcattggttattctagttagccattcatctaatctcttttcaaggtttttaacttctttgccatgggttcaaacttcctcctttagctcggagtagtttgatcatctgaagccttcttctgtcaactcgtcaaagtcattctctgtccagctttgttctgttgctggtgaggagctgcattcctttggaggaggagaggtgcttagatttttagaattttcagtttttctgctgttttttccccatctttgtggttttatctacctttggtctttgatgatggtgacatacagatggggttttggtgtggatgtcctttctgtttgttagttttccttccaacatttgggaccctcagctgcaggtctgttggagtctgctggaggtccacttcagaccctgtttgcctcggtattagcagcagaggctccagaacagtggatattggtgaacagcaaatgttgctgtctgatcgttcctctggaagttttgtctcagag

SEQ ID NO: 12635 - DNA, 6176 bp, Homo sapiens
cttttttttaaattttattttattattattatactttaagttttagggtacatgtgcacaatgtgcaggttagttacatatgtatacatgtgccatgctggtgtgctgcacccattaactcatcatttagcattaggtatatctcctaatgctattcctaccccctccctccaccccacaatagtccccagagtgtgatgttccccttcctgtgtccaggtgttctcattgttcaattcccacctatgagtgagaacatgtggtgtttggttttttgtccttgcgatagtttactgagaatgacggatttccagtttcatccatgtccctacaaaggacatgaactcatccttttttatggttgcatagtattccctggtgtatatgtgccacattttcttaatccagtctatcgttgttggacatttgggttggttccaagtctttgctattgtgaatagtgccacaataaacatacatgtgcatgtgtctttatagcagcatgatttataatcctttgggtaaatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactcgtgtgagatggtatctcattgtggttttgatttgcatttctctgatggccagtgatggtgagcattttttcatgtgtttgttggctgcataaatgtcttcttttgagaagtgtctgttcatgtcctttgcccactttttgatggggttgtttgtttttttcttgtaaatttgtctgagttcattgtagattctggatattagccctttgtcagaggagtaggttgtgaaaattttctcccattttgtaggttgcttcttcactctgatggtagtttcttttgctgtgcagaagctctttagtttaatgagatcccatttgtcaattttgtcttttgttgccattgcttttggtgttttagacatgaagtccttgcccatgcctatgtcctgaatggtaatgcctaggttttcttctagggtttttatggttttaggtcaacgtttaagtctttaatccatcttgaattgatttttgtataaggcataaggaagggatccagtttcagctttctacatgtggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccacatgaactttaaagtagttttttccaattctgtgaagaaagtcattggtcacttgatggggatggcattgaatctgtaaattaccttgggcagtatggccattttcacgatattgattcttcctacccatgagcatggaatgtcctcccatttgtttgtatcctcttttatttccttgagcagtggtttgtagttctccttgaagaggtccttcacgtcccttgtaagttggattcctagctattttattctatttgaagcaattgtgaatgggagttcactcatgatttggctctctgtttgtctgttattggtgtataagaatgcctgtgatttttgtacattgattttgtatcctgagactttgctgaatttgcttatcagcttaaggagattttgggctgagacgatggggttttctagatatacagtcatgtcatctgtaaacagggacaatttgacttcctcttttcctaattgaataccctttatttccttctcctgcctaattgccctggccagaacttccaacactacattgaataggagtggtgagagagggcatccctgtcttgtgccagttttcaaagagaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctacatctattgagataatcatgtggtttttgtctttggttctgtttatatgctggattacatttattgatttgcatatattgaaccagccttgcatcccagggatgaagcccacttgatcatggtggataagctttttgatgtgctgctggaatcggtttgccagtattttattgaggatttttgcatcaatgttcatcaaggatattggtctaaaattctctttattggttgtgtctctgcccggctttggtatcaggatgatgctggcctcataaaatgagttagggaggattccctctttttctattgattggaatagtttcagaaggaatggtaccagttcctccatgtacctctggtagaattccgctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgtgtggaggtgtttgtagtattctctgatggtagtttgtatttctgtgggatcggtggtgatatcccctttatcattttttattgcctctatttggttcttctctcttttcttctttattagtcttgctagcggtctatcaattttgttgatcctttcaaaaaaccagctcctgaattcattaattttttgaagggttttttgtgtctctatttccttcagttctgctctgattttagttatttcttgccttctgctagcttttgaatgtgtttgctcttgcttttctagttcttttaattgtgatgttagcgtgtcaattttagatatttcctgctttctcctgtgggcatttagtgctataaatttccctctgcacactgctttggatgtgtcccagagattctggtatgttgtgtctttgttctcatcagtttcaaagaacatctttatttatgccttcatttcattatgtacccagtagtcattcaggagcaggttgttcagcttccatgtagttgagtggttttgagtgagtttcttaatcctgagttctagtttgattgcactgtggtctgagagacagtttgttataatttctgttcttttacatttgctgaggagagctttacttccaactatgtggtcaattttggaatagttgtggtgtggtgctgaaaaaaatgtatattctgttgatttggggtggagagttctgtagatgtctattagatccacttggtgcagagctgagttcaattcttgggtatccttgttaactttctttcttgttgatctgtctaatgttgacagtgaggtgttaaagtctctcattattattgtgtgggagtctaagtcctttcgtaggtcactcaggacttgctttataaatctggttgctcctgtattgggtgcatatatatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcgcactgatgaatcttgactctttatccaatttgccagtccgtgtcttttaattggagcatttagtccatttacctttaaagttaatactgttatgtgtgaatttgaacctgtcattatgatgttagctggttattttgctcattagttgatgcagttgcttcctagcctcgatggtctttacaatttggcatgattttgcagcagctggtaccggttgttcctttccatgtttagtgcttccttcaggagctcttttagggcaggcctggtggtgacaaaatctctcggcatttgcttgtctgtaaagtattttatttctccttcacttatgaagcttagtttgtctggatatgaaattgtgggttgaaaattcttttctttaggaatgttgaatattggcccccacactctcctggcttgtagagtttctgccaagagatccactgttagtctgatgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatctcactgttggcctgccttgctagattggggaagttctcctggataatatcctgcagcgtgttttccaacttggttccattctccccgtcactttcaggtacaccagtcagacgtagatttggtcttttcatatagtcccatatttcttggaggctttgttcatttctttttatgcttttttctctaaacttcccttcttgcttcatttcattcatttcatcttccatcactgataccctttcttccagttgatcgcatcagctcctgaggcttctgcattcttcatgtagtcctcgagccttggctttcagctacatcagctcctttaagcacttctctgtattggttattctagttatacattcgtgaaaattgttttcaaagttttgaacttctttgcctttggtttgaatttcctcctgtagctcggagtagtttgatcatctgaagccttcttctctcaacctgtcaaagtcattctccatccagctttgttccgttgctggtgaggaactgtgttcctttggaggaggagaggcactctgctttttagagtttccagtttttctgctctgtcttttccccatctttgtggttttatctacttttggtctttgatgatgttgatgtacatcatcatgggtttttggtgtgaatgtcctttctgtttgttagttttccttctaacagacaggaccctcagctgcaggtctgttggagtttgctagaggtccactccagaccctgtttgcctgggtatcagcagcggtggctgcagaacagcggatttttgtgaaccgcgaatgctgctgtctgatcattcctctggaagttttgtctcagaggagtacccggccatgtgaggtgtcagtctgcccctaccgggggctgcttcccagttaggctgctcatgggtcaggggtcagggacccacttgaggaggcagtctgcccgttttcagatctccagctgcatgcggggagaaccactgctctcttcaaagctgtcagacagggacatttaagtctgcagaggtttctgctgtctttttatttgtctgtgccctgcccccagaggtggagcctacagaggcaggcaggcctccttgagctgtggtgggctccacccagttcgagcttcctggctgctttgtttacctatgcaagcctgggcaatggcaggtgcccctcccccagcctcgctgccaccttgcagtttgatctcagactactgtggtagcaatcggcgagactctgtgggtgtaggaccgcccgagccatgtgcgggatataatctactggtgcgccgtttttaaagcccatcagaaaagtgcagtattaggtagggagtgacccgattttccaggtgccgtctgtcacccctttctttgactaggaaagggagctccctgaccccttgcgcttcccgagtgaggcaatgccttgccctgcttcggctggcacacgttgcgctgcacccactgtcgtgcgcccactgtctggcactccctagtgagatgaacctggtacctcagatggaaacgcagaaatcacctgtcttctgcgtcgctcatgctgggagctgtagactggagctcttcctattcggccatcttggctgcca

SEQ ID NO: 12636 - DNA, 6175 bp, Homo sapiens
cttttttttaaattttattttattattattatactttaagttttagggtacatgtgcacaatgtgcaggttagttacatatgtatacatgtgccatgctggtgtgctgcacccattaactcatcatttagcattaggtatatctcctaatgctattcctaccccctccctccaccccacaatagtccccagagtgtgatgttccccttcctgtgtccaggtgttctcattgttcaattcccacctatgagtgagaacatgtggtgtttggttttttgtccttgcgatagtttactgagaatgacggatttccagtttcatccatgtccctacaaaggacatgaactcatccttttttatggttgcatagtattccctggtgtatatgtgccacattttcttaatccagtctatcgttgttggacatttgggttggttccaagtctttgctattgtgaatagtgccacaataaacatacatgtgcatgtgtctttatagcagcatgatttgtagtcctttgggtaaatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactcgtgtgagatggtatctcattgtggttttgatttgcatttctctgatggccagtgatggtgagcattttttcatgtgtttgttggctgcataaatgtcttcttttgagaagtgtctgttcatgtcctttgcccactttttgatgggttgtttgtttttttcttgtaaatttgtttgagttcattgtagattctggatattagccctttgtcagaggagtaggttgtgaaaattttctcccattttgtaggttgcttcttcactctgatggtagtttcttttgctgtgcagaagctctttagtttaatgagatcccatttgtcaattttgtcttttgttgccattgcttttggtgttttagacatgaagtccttgcccatgcctatgtcctgaatggtaatgcctaggttttcttctagggtttttatggttttaggtcaacgtttaagtctttaatccatcttgaattgatttttgtataaggcataaggaagggatccagtttcagctttctacatgtggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccacatgaactttaaagtagttttttccaattctgtgaagaaagtcattggtcacttgatggggatggcattgaatctgtaaattaccttgggcagtatggccattttcacgatattgattcttcctacccatgagcatggaatgtcctcccatttgtttgtatcctcttttatttccttgagcagtggtttgtagttctccttgaagaggtccttcacgtcccttgtcagttggattcctagctattttattctatttgaagcaattgtgaatgggagttcactcatgatttggctctctgtttgtctgttattggtgtataagaatgcctgtgatttttgtacattgattttgtatcatgagactttgctgaatttgcttatcagcttaaggagattttgggttgagacgatggggttttctagatatacagtcatgtcatgtgtaaacagggacaatttgacttcctcttttcctaattgaataccctttatttccttctcctgcctaattgccctggccagaacttccaacactacattgaataggagtggtgagagagggcatccctgtcttgtgccagttttcaaagagaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctacatctattgagataatcatgtggtttttgtctttggttctgtttatatgctggattacatttattgatttgcatatattgaaccagccttgcatcccagggatgaagcccacttgatcatggtggataagctttttgatgtgctgctggaatcggtttgccagtattttattgaggatttttgcatcaatgttcatcaaggatattggtctaaaattctctttattggttgtgtctctgcccggctttggtatcaggatgatgctggcctcataaaatgagttagggaggattccctctttttctattgattggaatagtttcagaaggaatggtaccagttcctccatgtacctctggtagaattccgctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgtgtggaggtgtttgtagtattctctgatggtagtttgtatttctgtgggatcggtggtgatatcccctttatcattttttattgcctctatttggttcttctctcttttcttctttattagtcttgctagcggtctatcaattttgttgatcctttcaaaaaaccagctcctgaattcattaattttttgaagggttttttgtgtctctatttccttcagttctgctctgattttagttatttcttgccttctgctagcttttgaatgtgtttgctcttgcttttctagttcttttaattgtgatgttagcgtgtcaattttagatatttcctgctttctcctgtgggcatttagtgctataaatttccctctgcacactgctttggatgtgtcccagagattctggtatgttgtgtctttgttctcatcagtttcaaagaacatctttatttatgccttcatttcattatgtacccagtagtcattcaggagcaggttgttcagcttccatgtagttgagtggttttgagtgagtttcttaatcctgagttctagtttgattgcactgtggtctgagagacagtttgttataatttctgttcttttacatttgctgaggagagctttacttccaactatgtggtcaattttggaatagttgtggtgtggtgctgaaaaaaatgtatattctgttgatttggggtggagagttctgtagatgtctattagatccacttggtgcagagctgagttcaattcttgggtatccttgttaactttctttcttgttgatctgtctaatgttgacagtgaggtgttaaagtctctcattattattgtgtgggagtctaagtcctttcgtaggtcactcaggacttgctttataaatctggttgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcgcactgatgaatcttgactctttatccaatttgccagtccgtgtcttttaattggagcatttagtccatttacctttaaagttaatactgttatgtgtgaatttgaacctgtcattatgatgttagctggttattttgctcattagttgatgcagttgcttcctagcctcgatggtctttacaatttggcatgattttgcagcagctggtaccggttgttcctttccatgtttagtgcttccttcaggagctcttttagggcaggcctggtggtgacaaaatctctcggcatttgcttgtctgtaaagtattttatttctccttcacttatgaagcttagtttgtctggatatgaaattgtgggttgaaaattcttttctttaggaatgttgaatattggcccccacactctcctggcttgtagagtttctgccaagagatccactgttagtctgatgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatctcactgttggcctgccttgctagattggggaagttctcctggataatatcctgcagcgtgttttccaacttggttccattctccccgtcactttcaggtacaccagtcagacgtagatttggtcttttcatatagtcccatatttcttggaggctttgttcatttctttttatgcttttttctctaaacttcccttcttgcttcatttcattcatttcatcttccatcactgataccctttcttccagttgatcgcatcggctcctgaggcttctgcattcttcatgtagtcctcgagccttggctttcagctacatcagctcctttaagcacttctctgtattggttattctagttatacattcgtgaaaattgttttcaaagttttgaacttctttgcctttggtttgaatttcctcctgtagctcggagtagtttgatcatctgaagccttcttctctcaacctgtcaaagtcattctccatccagctttgttccgttgctggtgaggaactgtgttcctttggaggaggagaggcactctgctttttagagtttccagtttttctgctctgtcttttccccatctttgtggttttatctacttttggtctttgatgatgttgatgtacatcatcatgggtttttggtgtgaatgtcctttctgtttgttagttttccttctaacagacaggaccctcagctgcaggtctgttggagtttgctagaggtccactccagaccctgtttgcctgggtatcagcagcggtggctgcagaacagcggattttcgtgaaccgcgaatgctgctgtctgatcattcctctggaagttttgtctcagaggagtacccggccatgtgaggtgtcagtctgcccctaccgggggctgcttcccagttaggctgctcatgggtcaggggtcagggacccacttgaggaggcagtctgcccgttttcagatctccagctgcatgctgggagaaccactgctctcttcaaagctgtcagacagggacatttaagtctgcagaggtttctgctgtctttttatttgtctgtgccctgcccccagaggtggagcctacagaggcaggcaggcctccttgagctgtggtgggctccacccagttcgagcttcctggctgctttgtttacctatgcaagcctgggcaatggcaggtgcccctcccccagcctcgctgccaccttgcagtttgatctcagactactgtggtagcaatcggcgagactctgtgggtgtaggaccgcccgagccatgtgcgggatataatctactggtgcgccgtttttaaagcccatcagaaaagtgcagtattaggtagggagtgacccgattttccaggtgccgtctgtcacccctttctttgactaggaaagggagctccctgaccccttgcgcttcccgagtgaggcaatgccttgccctgcttcggctggcacacgttgcgctgcacccactgtcgtgcgcccactgtctggcactccctagtgagatgaacctggtacctcagatggaaacgcagaaatcacctgtcttctgcgtcgctcatgctgggagctgtagactggagctcttcctattcggccatcttggctgcca

SEQ ID NO: 12637 - DNA, 6043 bp, Homo sapiens
gtattaattaaaatttttttttaatattattatactttaagttttagggtacatgtgcacattgtgcaggttagttacatgtgtatacgtgtgccatgctggtgtgctgcacccactaactcctcatctagcattaggtatatctcccaatgctatccctccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaagtacatgaactcatcattttttatggccgcataatattccatggtgtatatgtgacacattttcttaatccagtctatccttgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtattttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcgaaaattttctcccattttgtaggttgcccgttcactctgatggtagtttcttttgctgtgcagagctctttagttaattagatcccatttgtcaatttttgtcttttgttgccattgcttttggtgttttagacatgaagtccttgcccatgcctatgtcctgaatggtaatgcctaggttttcttctagggtttttatagttttaggtctaacgtttaagtctttaatccatcttgaattgatttttgtataaggtgtaaggaagggatccagtttcagctttctacatatggctagccagttttcccagcaccatttattaaatagggaatcctttctctattgcttgtttttgtcaggtttgtcaaagatcagatagttgtagatatgtggcgttatttctgagggctctgttctgttccattgatctatatctctgttttggtaccagtaccatgctgttttggttacggtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttatttgtatcctcttttatttccttgagcagtggattgtagttctccttgaagaggtccttcacatcccttgtaagttggattcctaggtattttattctctttgaagcaattgtgaatgggagttcactcataatttgtctctctgtttgtctgttgttggtgtataagaatgcttgtgatttttgtacattgattttgtatcctgagactttgctgaagttgctgctcagcttaaggagattttgggctgagacaatggggttttctagatatacaatcatgtcatctgcaaacagggacaatttgacttcctcttttcctaattgaataccctttatttccttcttctgcctaattgccctggccagaacttccaacactatgttgaataggagtggtgatagaggacatccctgtcttgtgccagttttcaaagggaatgcctccagtttttgcccattcagtatgatattgcctgtgggtttgtcatagatagctcttatgattttgaaatacgtcccaacagtacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcttcaaggatattggtctaaaattctctttttttgttgtgtctctgcctggctttggtatcagaatgatgctggcctcataaaatgagttagggaggattctctcttttcctattgattggaatagtttcagaaggaatggtaccagttcctccttgtacctctggtagaattcggctgtgaatccatctggtcctggactctttttggttggtaagctattgattattgccacaatttcagatcctgttattggtctactcagagattcaacttcttcctggtttagtcttgggagagtgtatgtgtcgaggaatttatccatttcttctagattttctagtttatttgcatagaggtgtttgtagtattctctgatggtagtttgtatttctgtgggattggtggtgatatcccctttatcattttttattgtatctatttgattcttctctctttttttctctattagtcttgctagcagtctatctattttgttgatcctttccaaaaaccaggtcctggattcattaattttttgaagggttttttgtgtctctatttccttcagttctgttctgattttagttatttcttgccttctgctagcttttgaatgtgtttgttcttgcttttctagttcttttaattgtgatgttagggtgtcaattttggatctttcctgctttctcttgtgggcatttagtgctataaatttccctctacacgctgctttgaatgcatcccagagattctggtatgttgtgtctttgttctcgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagagatagtttgttataagttatgttcgtttatatttgctgaggagagctttacttccaaatatgtgatcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctggttgatcctctattgggtgcatatatatttaggatagttagctcttcttgttgaattgatccctttaccattatgtaatggccttctttgtctcttttgatctttgttggtttaaagtctgttttattagagactaggattgcaacccctgcctttttttgttttccatttgcttggtagatcttccttcatccttttattttgagcctatgtgtgtctctgcacgtgaggtgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaaggattttatttctccttcacttatgaaacttagtttggctggatatgaaattctgggatgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggaattgctcttctcgaggagtatctttgtggcgttctctgtatttcctgaatctgaacgttgccctgccttgatagattggggaagttctcctggataatatcctgcagagtgttttcccacttagttccattctccccatcactttcaggtacaccaatcagacgtagatttggtcttttcacatagtcccatatttcttggaggctttgctcatttctttttattcttttttctctaaccttcccttctcacttcatttcattcatttcgtcttccattgctgataccctttcttccagttgattgcatcggctcctgagacttctgcattcttcacatagttctcgagccttggttttcagctccatcaactcctttaagcacttctctgtattggttattctagttatacattcttctaaatttttttcaaagttttcaacttctttccctttggtttgaatgtcctcccgtagctcagagtaatttgatcgtctgaagtcttcttctctcatctcctcaaagtcattctccatccagctttgttccgttgctggtgaggagctgcattcctttggaggaggagaggtgctctgctttttagagtttccagtttttctgttctgttttttccccatttttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcaggggtcaggggtcagggacccacttgaggaggcagtctgcccgttctcagatctccagctgcgtgctgggagaactacggctctcttcaaagctgtcagacagggacatttaagtctgcagaggttactgctgtctttttgtctgggccctgcccccagaggtggagcctacagaggcaggcaggcctccttgagctgtggtgggctccacccagttggagcttcctggctgctttgtttacctaatcaagcctgggcaatggcgggcgcccctcccccagcctcgctgccaccttgcagtttgatctcagacagctgtgctagcaatcagcgagactccgtgggcgtaggaccctccaagcgaggtgcgggatataatctcatggtgcactgttttttaagcccgtcggaaaagcgcagtattcgggtgggagtgacccgattttccaggtgctgtccgtcacctctttctttgactaggaaagggaactccctgaccccttgcgcttcccgagtgaggcaatgcctcgccttgctttggccctcgcacggtgcacgcacccactggcctgcgcccactgtctggcactccctagtgagatgagcccggtacctcagatggaaatgcagaaatcacccatcttctgcgtcgctcatgctgggagctgtagatgggagctgttcctattcggccatcttggcttctccccct

SEQ ID NO: 12638 - DNA, 776 bp, Homo sapiens; identical to SEQ ID NO: 7382
  misc_feature (709)..(709): n equals a,t,g, or c
  misc_feature (738)..(738): n equals a,t,g, or c

SEQ ID NO: 12639 - DNA, 5585 bp, Homo sapiens
ctttttttttctttttattttattattattatactttaagttttagggtacatgtgcacaacgtgcaggtttgttacatatgtatacatgtgccatgttggtgtgctgcacccattaactcgtcatttagcattgggtatatctcctaatgctatccctccccccttcccccaccccacaacagtccccactctgtgatgttccccttcctgtgtccatgtgttctcactgttcaattcctacctatgagtgagaacatgcagtgtttggtattttgtccttgagatagtttgctgagaatggtggtttccagattcatccatgtccctacaaaagacatgaactcatcattttttatggctgcatagtattccatggtgtatatgagccacattttcttaattcagtctattgtttttggacatttacattggttccaagtcattgctattgtgaatagtgcttctataaacctatgtgtgcatgtgtctttacagcagcatgatttataatcctttgggtatatacccagtactgggatggctgggtcaaatggtatttctagttctagatccctgagggattgcctcactgacttccacaatggttgaagtagtttatagtcccaccaacagtgtaaaagtgttcctgtttctccacatcctctccagcacctgttgtttcctgactttttaatgatcaccattctaactggtgtgagctggtatctcattgtgtttttgatttgcatttctctgacggccagtgatagtgagcattttttcatgtgttttttggctgcataaatgtcttcttttgagaagtgtctgttcatgtccttcgcccactttttgatggggttgtttgatttttttcttctaaatttgtttgagttcattgaagattctggatattagccctttgtcagatgagtagattgcaaaaattttctcccattctgtaggttgtctgttcactctgatggtagtttcttttgctgtgcagaagctctttagtttaattagaacccatttgtcaattttggcttttgttgccattgcttttggtgttttagacatgaagtccttgcccatgcctatgtcctgaatggtattacctaggttttcttctagcgtttttatggttttaggtctaacatttaagtctttaatccatcttgaattaatttttgtatagggtgtaaggaagggatccagtttcagctttctacatatggctaggcagttttcccagcaccatttattaaatagggaatcctttccccattgcttgttcttgtcaggtttgtcaaagatcagatagttgtagatatgtggcattatttctgagggctctgttccattccattggtctatatctctgttttggtaccagtaccatgctattttggttactgtagccttgaagtatagtttgaagtcaggtagtgtgatgcctccggctttgttcttttggcttaggattgacttggcaatgcaggttcttttttggttccatatgaactttaaagtagttttttccaattctctgaagaaagtcattggtagcttgatggggatggcattgaatttataaattaccttgggcagtatggccattttcacgatattgattcttcctacccatgagcatggaatgttcttccatttctttgtatcctcttttatttcactgaacagtggtttatagttctccttgaagaggtccttcacatcccttgtaagttggattcctaggtattttattctctttgtagcaattgtgaatgggagttcactcatgatttggctctctgtttgtttgttattggtgtataagaatgcttgtgatttttgtacattgattttgtatcctgagactttgctgaagttgcttatcagcttgaggagattttgggctgagacaatggggttttctagatatacaatcatgtcatctgcaagcagggacaatttgacttcctcttttcctaattgagtaccgtttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaaggttgttcaattttgtcaaaggccttctctgcatctattgagaaaatcatgtggtttttgtctttggttctgtttatatgctggattacatttattgatttgcatatgttgaaccagccttgcatcccagggatgaagcccacttgattatggtggataagctttttgatgtgctgctgtattcggtttgccagtattttattgaggatttttgcatcaatgttcatcaaggatattggtctaaaattctcttttttggttgtatctctgccaggcttttgtatcaggatgatgctggcctcataaaatgagttatggaggattccctctttttctattgattggaatagtttcagaaggaatggtaccagcttctcctttcacctctggtagaattcggctgtgaatccatctggtcctggactttttttggttggtaagctattgattattgcctcaatttcagatcctgttattggtctattctgagattcaacttcttcctgctttagtcttgggaggatgtatgtgtcgaggaatttatccatttcttctagattttctagtttatttgtgtagagatgtttatagtattctctgatggtagtttgtatttctgtgggatcagtggtgatatcccctttatcattttttattgtgtctatttgattcttctctcttttcttctttattagtcttgctagtggtctatcgattttgttgatctcttcagaaaatcagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacatactgctttgaatgtgtcccagagattctggtatgttgcgtctttgttctcgttggtttcaaagaacatctttatttctgccttcatttctttacttacccagtagtcattcaggagcaggttgttcagtttccatgtagttgagcggttttgagtgagtttcttaatcctgagttccattttgattgcactgtggtctgagaggcagtttgttgtaatttctgttcttttacatctgctgaggagtgctttacttccaactatgtggtcaattttggataggtgtggagaggtgctgaaaagaatgtatattctgttaatttggggtggagagttctgtagatgtctattaggtccgcttggtgcagagctgagttcagttcctgggtatccttgttaactttctgtctcgttgatctgtctaatgttgacagtggggtgttaaagtctcccattactattgtgtgggagtctaagtctctttgtatgtcactaaggacttgctttatgaatctgggtgctcctgtattgggtgcatatacatttaggatagttagctcttcttgctgaattaatccctttaccattatgtaatggccttctttgtctcttttgatctttgttggtttaaagtctgttttatcagagactaggattgcaacccctgccttcttttgttttccatttgcttggtagatcttcctccatccctttattttgagcctatatgtgtctctgcatgtgagatgggtttcctgaatacagcacactgatgggtcttgactctttatccaatttgccagtctgtgtcttttaattggagcatttagcccacttacatttaaagttaatattgttatgtgtgaatctgatgttgtcattatgatgttagctggttattttgctcgttagttgatgcagtttcttcctagccttgatggtctttacaatttggcatatttttgcagtggctggtaccagttgttcctttccatgtttagtgcttccttcaggagctcctttagggcaggcctggtggtgacaaaatctctcagcatttgcttgtctgtaaaggattttattgctccttaacttatgaagcttagtttggctgcatatgaaattctgggttgaaaattcttctctttaagattgttgaatattggtccccactctcttctggcttgtagagtttctgccgagagatccactgttagtctgatgggcttccctttgtgggtaacctgacctttctctctggctgcccttaacatttttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaacaatcagacgtagatttggtcttttcacatagtcccatatttcttggaggctttgttcatttctttttattcttttttctctatacttctcttctcacttcagttcattcatttcgtcttccatcactggtaccctttcttccagttgatcgcatcggctactgaggcttctgcattcgtcatgtcctctcgtgccttggttttcagctccatcaggtccttcaaggacttctctgcattgattattctagttatccattcgtctaattttttttcaaagcttttaacttctttgccattggtttgaatttcctcctgtagctcagagtagtttgatcttctgaacccttcttctctcaactcgtcaaagtcattctctgtccagctttgttccattgctggtgaggagctgcgttcctttggaggaggaaaggcgctcggatttttagagtttccagtttttctgctctgtttatttcccatctttgtggttttacctacctttgctctttgatgatggtgacgtacagaagggtttttggtgtggctgtcctttctgtttgttagttttccttctaacagacaggaccctcagctgcaggtctgttggagtttgctagaggtccactccagaccctgtttgcctgggtatcagcagtggtggctgcagaacagtggatattggtgaaccgcaaatgctgctgcctgatggttcctctggaagttttgtctcagaggagtacctggccgtgtgaggtggcagtccgcccctactggggggtgactcccagttaggctactcgggggtcagggacccatttgatgaggcagtctgcccattctcagatctcaagctgcgtgctgggagaaccactactctcttcaaagctgtcagacagggacatttaagtctgcagaggttactgctg

SEQ ID NO: 12640 - DNA, 6085 bp, Homo sapiens
ttcttttttttttttatttcttgtttcttttttatttatttatttttttattgttatactttaagttttagggtacatgtgcacattgtgcaggttagttacatacgtatacatgtgccatgctggtgtgctgcacccactaactcgtcatctagcattaggtatatctcccaatgctatccctcccccctctccccaccccgcaacagtccccagagtgtgatgttccccttcctgtgtccatgtgatctcattgttcaattcccacctatgagtgagaatatgcggtgtttggttttttgtccttgtgatagtttactgagaatgatggtttccaatttcatccatgtccctacaaaggacatgaactcatcattttttatggctgcatagtattccatggtgtatatgtgccacattttcttaatccagtctgtcattgttgggcatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctggggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggagttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatttgggctcttttttggttccatatgaactttaaagtagttttttccaattctgtgaagaaaggcattggtaggttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcctgtgatttttgcacattgattttgtatcctgagactttgctgaagttgcttatcagcttaaggagattttgggctgagacaatggggttctctagatatacaatcatgtcatctgcaaacagggacaatttgacttacttcctcttttcctaattgaatatcctttatttccttctcctgcctaattgccctggccagaacttccaacactatgttgaataggagtggtgagagagggcatccctgtcttgtgccagttttcaaagggaatgcttccagtttttgcccattcagtaggatattggctgtgggtttgtcatagatagctcttattattttgaaatatgtcccatcaagacctaatttattgagagtttttagcatgaaaggttgttgaattttgtcaaaggccttttctgcatctattgagataatcatgtggtttttgtctttggctctttttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattgttctaaaattctcttttttggttgtgtctctgcccggctttggtatcagaatgatgctggcctcataaaatgagttagggaggattccctctttttctattgattggaatagtttcagaaggaatggtaccagttcctccttttacctatggtagaatttggctgtgaatccatctggtcctggactctttttggttggtaagctattgattattgccacaatttgagatcctgttattggtctattcagagattcaacttcttcctggtttagtcttgggagagtgtatatgtcaaggaatttatccatttcttctagattttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagagttttttgtgtctctatttccttcacttctgctcggattttagttatttcttgccttctgctagcttttgaatgtgtttgctcttgcttttctagttcttttaattgtgatgttagggtgtcaattttgcatctttcctgctttctcttgtgggcatttagtgctataaatttccctctacacactgctttgaatgcatcccagagattctggtatgttgtgtctttgttcacagtggtttcaaagaacatctttatttctgccttcatttcattatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgtttactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttagggtagttagctcttcttgttgaattcatccctttaccattatgtaatggccttctttgtctcttttgatctttgttggtttaaagtctgttttatcagagactaagattgcaacccctgcctttttttgttttccatttgcttggtagatcttcctccatccttttattttgagcctatgtgtgactctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacatcttggcatgattttgcagcagctggtaccagttgttcctttccatgtttagcacttccttcaagagctcttttagggcaggcctggtggtgacaaaatctctcagcatttgcttgtctgtaaagtattttatttctccttcactcatgaagcttagtttggctggatatgaaattctgggttgaaaattcttttctttaagaatgttgaatattggcccccactctcttctggcttgtagggtttctgccgagagatccgctattagtctgatgggcttccctttgagggtaacgtgacctttctctctggctgcccttaacattttttccttcatttcaactttggtgaatctgacaattatgtgtcttggagttgctcttctcgaggagtatctttgtggcgttctctatatttcctgaatctgaacgttggcctgccttgctagactggggaaattctcctggataatatcctgcagagtgttttccaacttggttccattctccccatcactttcaggtacaccaatcagacgtagatttggtcttttcacatagtcccatatttcttggaggctttactcatttctttgtattcttttttctctaaactttccttctcgcttcatttcattcatttcttcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaacgtcctcccgtagctcagagtaatttgatcgtctgaagccttcttccctcagctcatcaaagtcattctccatccagctttgttccgttgctggtgaggagctgcattcctttggaggaggagaggcactctgatttttagtttccagtttttctgctctgttttttccccatctttgtggttttatctacttttggtctttgatgatggtgatgttcagatgggtttttggtgtggatgtcctttctgtttgttagttttccttctaacagacaggaccctcagctgcaggtctgttggagtaccctgccgtgtgaggtgtcagtgtgcccctgctggagggtgcctcccagttaggctgctcgggggtcaggggtcagggacccacttgaggaggcagtctgcccgttctcagatctccagctgtgtactggaagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttagagcttccgggctgctttgtttacctaagcaagcctgggcaatggcgggcgcccctcccccagcctcgctgccgccttgcagtttgatctcagactgctgtgctagcagtcagcgagactccgtgggcgtaggaccctctgagccaggtgcgagatataatctcgtggtgtgccgttttttaagccggttggaaaagcgcggtattcgggtgggagtgacccgattttccaggtgccgttcgtcacccctttctttgactaggaaagggaactccctgaccccttgcgcttcccaagtgaggcaatgcctcgccctgctttgggtcgcgtcggtgtgcgcacccactgacctgcgcccactgtctggcactccctagtgagatgaacccggtacctcagatggaaatgcagaaatcacccgtcttctgcgtcgctcaggctgggagctgtggaccggagctgttcctattcggccatcttggctcctcgcagttcattctttgt

SEQ ID NO: 12641 - DNA, 6043 bp, Homo sapiens
aattcttttttttttttaaattatgctttaagttttagggtccatgtgcacattgtgcaggttagttccatatgtatacatgtgccatgctggtgctctgcaccctctaactcctcatctagcattaggtatatctcccagtgctatccctcccccctccccccaccccacaacagtccccagagtgtgatatatcccttcctgtgtccatgtgatctcattgttcaattcccacctatgagtgagaatatgcggtgtttggttttttgttcttgcgatagtttactgagaatgatgatttccaatttcatccatgtccctacaaaggacatgaagtcatcattttttatggcggcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgtgtatacacccagtaatgggatggctgggtcaaatgctatttccagttctagatccctgaggaatcgccacactgacttccacaatggttgaactagtttacagtcccgccaacagtgtaaaagtgttcctgtttctccacatcttctccagcacctgttgtctcctgacttttaaatgattgccattctaactggtgtgagatggtatctcactgtggttttgatttgcatttctctgatggccagtgatgatgagcattttttcatgtgttttttggctgcataaatgtcttcttttgagaagtgtctgttcatgtccttcacccactttttgatgaggttgtttgttttttcttgtaaatttgttttagctcattgtagattctggatattagccctttgtcagatgagtaggttgtgaaaattttctcccattttgtaggttgcctgttcactctgatggtagtttctttttctgtgcagaagctctttagtttaattagatcccatttgtcaattttgtcttttattgccattgcttttggtgttttagacgtgaagtcctcgcctatgcctatgtcctgaatggtaatgcctaggttttcttctagggtttttatggttttacgtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatgtgaactttaaagtagttttttccaattctgtgaagaaaggcattggtagcttgatggggatggcattgaatctgtaaattaccttgggcagtatggccattttcacgatattgattcttcctactcatgagcatggaatgttcttccatttgtttgtatcctcttttatttccttgagcagtggtttgtagttctccttgaagaggtccttcacatcccttgtaagttgatttcctaggcattttattccctttgaagcaattgtgaatgggagttcactcatgattgggctctctgtttgtctgttgttggtgtataagaatgcttgtgatttttgtacattgattttgtatcctgagactttgctgaagttgcttatcagcttaaggagattttgggctgagacaatggggttttctagatatataatcatgttgtctgcaaacagggacaatttgacttcctcctttcctaattgaataccctttatttccttctcctgcctaattgccctggccagaacttccaacactatgttgaataggagtggtgagagagggcatccctctcttgtgccagttttcaaagggaatgcttccagtttttgcccattcagtatgatattggctgtgggtttgtcatagatagctcttactattttgaaatacgtcccatcaatacctaatttattgagagtttttagcatgaagggttgttgaattttgtcaagggctttttctgcatctattgagataatcatgtgttttttgtctttggttctgtttatatgctggattacatttattgatttgcgtatattgaaccagccttgcatcccagcgatgaagcccacttgatcatggtggataagctttttgatgtgccgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattctgtctttttctgttgattggaatagtttcagaaggaatggtaccagttcctccttgtacctctggtagaattcggctgtgaatccatctggtcctggactctttttggttggtgagctattgattattgccacaatttcagctcctgttattggtctattcagagattcaacttcttcctggtttagtcttgggagagtgtatgtgtcgaggagtttatccatttcttctagattttctagtttatttgcgtagaggtgtttgtagtattctctgatggtagtttgtatttctgtgtgatcagtggcgatatcccctttatcattttttattgcgtctattggattcttctctctttttttctttattagtcttgctagcggtctgtcacttttgttgatcctttcaaaaaaccagctcctggattcattaattttttgaagggttttttgtgtctctatttccttcagttctgctctgatcttagttatttcttgccttctgctagcttttgactgtgtttgctcttgcttttctagttcttttaattgtgatgttacggtgtcaattttggatctttcctgctttctcttgtgggcatttagtgctataaatttccctctacacactgctttgaatgcatcccagagattccggtatgttgtgtctttgttctcgttggtttcaaagaacatctttatttctgccttcattttgttatgtacccagtagtcattcaggagcaggttgttcagtttccatgtagttgagtggttttgagtgagattcttaatcctgagttctagtttgattgcactgtggtctgagagatagtttgttataatttctgttcttttacatccgctgaggagagctttacttcccagtatgtggtcagttttggaataggtgtggtgtggtgctgaaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctctttcgatctttgttggtttaaagtctgttttatcagagactaggattgcaacccctgcctttttttgttttccatttgcttggtagatcttcctgcatccttttattttgagcctatgtgtgtctctgcacgtgagatgggtttcctgaatacagcacactgatgggtcttgactctttatccagtttgccagtctgtgtcttttaattggagcatttagtccattgacatttaaagttaatattgttatgtatgaatttgatcctgtcattatgatgttagctggttattttgcttgttagttgatgcagtttcttcctagtctcgatggtctttacattttggcatgattttgcagcggctggtaccggttgttcctttccatgtttagtgcttccttcaggagctcttataaggcaggcttggtggtgacaaaatctctcagcatttgcttgtctgtaaagtattttatttctccttcgcttatgaagcttagtttggctggatatgaaattctgggttgaaaattattttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccagcttggttccattctcccgatcactttcaggtacaccaagcagacgtagatttggtcttttcacatagtcccatatttcttggaggctttgctcatttcgttttattcttttttctccaaacttcccttctcacttcatttcattcatttcatcttccattgctgataccctttcttccagttgatcgcatcagctcctgaggcttctgcattcttcacgtagttcttgagccttggttttcagctccatcagctcctttaagcacttctctgtattggttattctagttatacattcttctacattttttttttccaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccctctttgtggttttatctacttttggtctttgatgatggtgatgtacagatgggtttttggtgtggatgtcctttctgtttgttagttttccttctaactgagaggaccctcagctgcaggtctgttggaataccctgccgtgtgaggtgtcagtgtgcccctgctggggggtgcctcccagttaggctgctcggggggtcaggggtcagggacccacttgaggaggcagtctgcccgttctcagatctccagctgcgtgctgggagaaccactgctctcttcaaagctgtcagacagggtcatttaagtctgcagaggttactgctgtctttttgtttgtctgtgccctgcccctagaggtggagcctacagaggcaggcaggcctccttgagctgtggtgggctccacccagttggagcttccctgcggctttgtttacctaatcaagcctgggcaatggcgggcgcccctcccccagcctcgttgccgccttgcagtttgatctcagactgctgtgctagcaatcagtgagactgcgtgggcgtaggaccctccgagccaggtgcgggatataatctagtggtgtgccgttttttaagcccgtcggaaaagcgcagtattcgggtgggagtgacccgattctccaggtggcatccgtcacccctttctttgactcagaagggaactccctgaccgcttgcgcgtcccaagtgaggcaatgcctcgccctgcttccgctcgcacgcggtgagcccacccactgacctgcgcccactgtctggcactccctagtgagatgaacccggtacctcagatggaaatgcagaaatcacccgtcttcggcgtcgctcacgctgggagctgtagactggagctgttcctattcggccatcttggctcctccccc

SEQ ID NO: 12642 - DNA, 6181 bp, Homo sapiens
tttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagac

SEQ ID NO: 12643 - DNA, 7917 bp, Homo sapiens
tcacatattttttttttttttttttttttttgagacggagtctcgctgtgtctcccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctggatctcctgacctcatgatccgcccgtctcggcctcccaaagtgctaggattacaggcgtgagccaccgcgcccggcctcttttcacatatttaaggaagtgtgttaaagtctttatctagtacatttgatgcctaatgtctctttttggacgatttctgtagatttattttgtttctataaatagactatgcttttgtgtttttttctatgacttgctatatatttttcgaaaattaggcatttgaaaaaaaaaaaaatcccaaccactttttccagtctttgcagaatggctccttgcagggatagacttttattacttagcagggtacatttttgtccttgggattggcccaggcaatcccagcctttgcaggccttttctcagcctgtatttcccctgagctctttttctccaatttctccacatataatcaaattttatgtgtcttagtttccctacgagtctcactgctgcttctttttggggacatggcagttaaattgtattcccctaccaataatctcctgcccttggggtctatgggtctatagtccccctgtggttttcatgagctgtactcactgcttctcgtgacttttcttagcttgagatctgggccgtatcaattttggccatctaagctccattttaggtgacagaaatcaatccgtcaggttgccctcagacaggttagaacatggaaaattaggtctactcttctctctctggtttgaaggagagctggggactgagccacctcttccccaaaagcatgtaacaccagcaaggtgtgggtcaaaggcaagtaacaatgtcatgaaatttcctagctttttgaatgtgactttttcttcactgggcatttgcttggtttctattgatctctgactgatttccagaactcctatacagttatatagattttagtagtttctttttaatgtgttttataggggaaagatggcttgaatcttcccagttcaccattcttctttaagtttttaacttttgaaggataatttcactggacacaaatttctagattggggcttttctacctttgatactttaaatttttgcttcactaccttccttctggcatggctctgagaagtccaatgtaattcttatccttgctactctaaatttaagttttcttccccctctaaagctcctttcaatattttttctttgtctttgattttctgcagtttgaatatgatatgcctaggtatggagttttgggtatttattcttcttggagttctttgagcttcctagatctgtggtttggtgtctatcattacctttgggaaattctcagtcattattgcttcaaatttttcttctcttcatttttctctttcttcttcttctggtattgtcattacatctttatgtaatgttatgctacactacataaagttatgttacaccttttctaattgtcccacatttcttggatattgttatgtctttccattttttttcttgttgcatttcagcttaggagggttctattaacatttctttaaactcactgattttctttttccttggccatgctcagcctaatagtctattggtgagcccatcaaagccattcttcatttctattacatttgatttgtagcatttagttttcattcttttttttattattatactttaagtttcagggtacatgtgcacaatgtgcaggttagttacatatgtatacatgtgacatgctggtgcgctgcacccactaactcatcatctagcattaggtgtatctcccaatgctatccctcccctctgcccccaccccacaacagtccccagagtgtgatgttccccttcctgtgtctatgttttctcattgttcaattcccacctatgagtaagaatatgcggtgtttggttttttgttcttgcgatagtttactgagaatgatgatttccaatttcaaccatgtccctacaaaggacatgaagtcatcattttttatggctgcatagtattccatggtgtatatgtgccacattttcttaatccagtctatcattgttggacatttggcttggttccaagtctttgctattgtgaatagtgccgcaataaacatacgtgtgcatgtgtcttcatagcggcatgatttatagtcctttgggtctatacccagtaatgggatggctgggtcaaatggtatttctagttctagatccctgaggaatcaccacagtgacttccacaatggttgaactactttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtcaatttgtttgagttcattgtagattctggatattagccctttgtgagatgagtaggttgcgaaaattttctcccattttgtaggttgcctgttcactctggtggtagtttcttttgctgtgcagaagctctttagtttaattagatcgcatttgtcaattttggcttttgttgccattgcttttggtgttttagacatgaagtccttgcccatgcctatgtcctgaatggtaatgcctaggttttcttctaggttttttatggttttaggtctaacgtttaaatatttaatccatcttgaattgatttttgtataaggtgtaaggaagggatccagtttcagctttctacatatggctagccagttttcccagcaccatttattaaatagggaatcctttccccattgcttgtgtttctcaggtttgtcaaagatcagatagttgtagatatgcggcgttatttctgagggctctgttctgttccattgatctatatctctgttttggtaccagtaccatgctgttttgcttactgtagccttgtggtatagtttgaagtcaggtagcgtgatgcctccagctttgttcttttggcttaggattgacttggagatgcgggctcttttttggttccatatgaacttgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaaagcttgtgatttttgtacattgtttttgtatcctgagactttgctgaagttgcttatcagcttaaggagattttgggctgagacgatggggttttctagctatacaatcatgtcatctgcaaacagggacaatttgacttcctcttttcctaattgaataccctttatttccttctcctgcctgattgccctggccagaacttgcaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattgttctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctattgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtactggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctggatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagggtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacctgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccct

SEQ ID NO: 12644 - DNA, 6041 bp, Homo sapiens
tatattttcttcttttttttttttattatactttaagttttagggtacatgtgcacattgtgcaggttagttacatacgtatacatgtgccatgctggtgcgctgcacccactaactcgtcatctagcattaggtatatctcccaatgctatccctcccccctccccccaccccacaacagtccccagagtgtgatattccccttcctgtgtccatgtgctctcattgttcaattcccacctatgagtgagaatatgcggtgtttggttttttgttcttgcgatagtttactgagaatgatgatttccaatttcatccatgtccttacaaaggacatgaactcatcattttttatggctgcatagtattccatggtgtatatgtgccaccttttcttaatccagtctatcattgttggacatttgggttggctccaagtctttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgactgccattctaactggtgtgagatggtatctcatagtggttttgatttgcatttctctgatggctagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttgtcttctgttgccattgcttttggtgttttagacatgaagtccttgcccatgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagtcgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggttcttttttggttccatatgaactttaaagtagtttttttccaattctgtgaagaaagtcattggtagcttgatggggatggcattgaatctgtaaattaccttgggcagtatggccattttcgcgatattgattcttcctatccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctttctgtttgtctgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtctgtcatagatagctcttattattttgaagtacgtcccattaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcagaacgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatctctcctagattttctagtttatttgcatagagctgtttgtagtattctctgatggtagtttgtatttctgtgggatcggtggtgatatcccctttatcattttttattgcgtctatttgattcttctctctttttttattagtcttgctagtggtctatcaattttgttgatcctttcaaaaaaccagctcctggattcattgattttttgaagggttttttgtctctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaatatctttatttctgccttcatttcgttaggtacccagtagtcattcaggagcaggttgttcagtttccatgtagttgagcagctttgagtgagattcttaatcctgagttctagtttgattgcactgtggtctgagagatagtttgttacaatttctgttcttttacatttgctgaggagagctttacttccaagtatgtggtcaattttggaataggtgtggtgtggtgctgaaaaaaatgtatattcttttgatttggggtggagagttctgtagatgtctattaggtctgcttggttcagagctgagttcaattccctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaaggctgttttatcagagactaggattgcaacccctgccttttttaattttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagcaggtgattttgctcgttagttcatgcagtttcttcctagtctcgatggtctttacattttggcatgattttgcagcggctggtaccagttgttcctttccatgtttagtgcttccttcaggagctcttttagggcaggcctgctggtgacaaaatctctcagcatttgcttgtgtgtaaaggattttatttctccttcacttatgaagcttagtttggctggatatgaaattctgggttgaaaattcttttctttaagaatgttgaatattggcccccactcttctggcttgtagggtttctgccgagagatcagctgttagtctgatgggcttccctttgagggtaacccgacctttctctctggctgcccttaacatttcttccttcatttcaactttggtgaatctgacaattatgtgtcttggagttgctcttcttgaggagtatctttttggcgttctctgtatttcctgaatctgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgcgttttagagtttccactttttctgttctgttttttccccatctttgtggttttatctacttttggtctttgatgatggtgatgtacagatgggttttcggtgtggatgtcctttctgtttgttagttttccttcttacagacaggaccctcagctgcaggtctgttggaataccctgccgtgtgaggtgtcagtgtgcccctgctggggggtgcctcccagttaggctgctaaggggtcaggggtcagggacccacttgaggaggcagtctacccattctcagatctccagctgcgtactgggagaaccactgctctcttcaaagctgtcagacagggacatttaagtctgcagaggttactgctgtctttttgtttgtctgtgccctgtccccagaggtggagcctacagaggcaggcaggcctccttgagctgtggtgggctccacccagttggagcttcctggctgctttgtttacctaatcaagcctgggcaatggcgggcgcccctcccccagcctcgctgccgccttgcagtttgatctcagactgctgtgctagcaaccagcgagactccgtgggcgtaggaccctctgagccaggtgtgggatatagtctcatggtgcgccattttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggcttgcgcacagtgcgcgcacccactggcctgcgcctactgtctggcactccctagtgagatgaacctggtacctcagatggaaatgcagaaatcacccgtcttctgcgtcgctcacgctgggagctgtagactggagctgttcctattcggccatcttggctcctctctgcc

SEQ ID NO: 12645 - DNA, 6063 bp, Homo sapiens
atacacatattagtttattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttccattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttagagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgagtttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattacttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagatgtccttcacatcccttgtaagttggattcctaggtattttattctctttgaagcaattgtgaatgggagttcactcatgatttggctctctgtttgtctgttgttggtgtgtaagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggttggccagtattttattgaggatttttgcatcaatgttcatcaaggatattggtctaaaattctccttttttggttgtgtctctgcccggctttggtatcagaatgatgctggcctcataaaatgagttagggaggattccctcttttctattgattgggatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagagtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatggagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatactctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttgcctaagcaagcctgggcaatggcgggcgcccctcccccagcctcgttgccgccttgccgtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccg

SEQ ID NO: 12646 - DNA, 6168 bp, Homo sapiens
atatatattttttcttttattattattataccttaagatttagggtacatgtgcacaatgtgcaggttagttacatatgtatacatgtgccatgctggtgtgctgcacccattaacacgtcatttagcattaggtatatctcctaatactatccctccccactccccccaccccacaacagtccccggagtgtgatgttccccttcctgtgtccatgtgttctcattgttcaattcccacctatgagtgagaatatgcggtgtttggttttttgttcttgcgatagtttactgagaatgatgatttccaatttcatccctgtccttacaaaggacatgaactcatcattttttatggctgcatagtattccatggtgtatatgtgccacattttcttaatccagtctgtcattgttggacatttgggttggttccaagtctttgctattgtgaatagagccacagtaaacatacgtgtgcatgtgtctttatagcagcatgatttatactcctttgggtatatacccagtaatgggatggctaggtcaaatggtatttctagttctagatccctgaggaattgccacactgacttccacaatggttgaactagtttacagtcccaccaacagtgtaaaagtgttcctatttctccacatcctctccagcacctgttgtttcctgacatttaatgattgccattctaactggtgtgagatggtatctcattgtggttttgatttgcatttctctgatggccagtggtggtgagcattttttcatgtgttttttggctgcataaatgtcttcttttgagaagtgtctgctcatatccttcacccactttttgatggggttgtttgttttcttcttgtaaatttgtttgagttcattgtagattctggatattagccctttgtcagatgagtaggttgcgaaaattttcttccattttgtaggttgcctgttcactctgatggtagtttcttttgctgtgcagaagctctttagtttaattagatcccatttgtcaattatggcttttgttgccattgcttttggtgttttagacatgaagtccttgcccatgcctatgtcctgaatggtaatgcctaggttttcttctagggtttttatggttttatgtctaacatgtaagtctttactccatcttgaattaattttcatataaggtgtaaggaagggatccagtttcagctttctacatatggctagccagttttcccagcaacatttattaaatagggaatcctttccccattgcttgtttttctcaggtttgtcaaagatcacatagttgtagatatgcggcgttatttctgagggctctgttctattccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggtgccatatgaactttcaagtagttttttccaattctgtgaagaaagtcattggtagcttgatgcggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttactggtgtataagaatgcttgtgatttttgtacattgactttgtatcctgagactttgctgaaattgcttatcagcttaaggagattttgggctgagacaatagggttttctagatatacaatcatgtcatctgcaaacagggacaatttgacttcctcttttcctaactgaataccctttatttccttctcctgcctaattgccctggccagaaattccaacactatgttgagtaggagtggtgagagagggcatccctgtcttgtgctagttttcaaagggaatgcttccagtttttgcccattcagtatgatattggctgtgggtttgtcatagatagctcttattatttcgagatacatcccatcaatacctaatatattgacagtttttagcatgaagggttgttgaattttttcaaagatcttttcttcatctattgagataatgatgtggtttttgtctttggttctgtttatatgctggattacatttattgatttgcgtatgttgaaccagtcttgcatcccagggatgaagcccacttgatcatggtggataagctttttgatgtgctgctggatttggtttgccagtattttattgaggatttttgcatcaatgttcatcaaagatattggtctaaaattctctttttttgttgtgtctctgccaggctttggtatcagaatgatgctggcctcataaaatgagttagggaggattccctctttttctattgattggaatagtttcagaaggaatggtaccagttcctccttgtacctctggtagaatttggctgtgaatccacctggccctggactctttttggttggtaagctattgattattgccacaatttcagagcctgttattggtgtattcagagattcaacttcttcctggtttagtcttgggagagcgtatgtgttgaggaatttatccatttcttctagattttctagtggttatttgcgtagaggtgtttgtagtattctctgatggtagtttgtattcctgtgggatcggtggtgatatcccctttatcattttttatagcgtctatttgattcttctctctttttttctttattagtcttgctagcggtctgtcaattttgttgatcctttcaaaaagcagctcctggattcattaattttttgaagggttttttgtgtctctatttccttcagttctgctcggattttagttatttcttgccgtctgctagcttttgaatgtgtttgttcttgcttttctagttctttgaattgtgatgttagggtgtcaattttggatctttcctgctttctcttgtgggcatttagtgctataaatttccctctacacactgctttgaatgtgtcccagagattctggtacgttctgtctttgttctcattggtttcaaagaagatctttgtttctgccttcattttgttatgtacccagtagtcattcaggagcgggttgttcagtttccatgtatttgagcagttttgagtgcgtttcttaatcctgaggtctagtttgattgcactgtggtctgagagacagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaactctcccattattattatgtgggagtctaagtctctttgtaggtcactcaggacttgctttatgaatctcggtgctcctgtattgggtgcatatatatttaggatagttagctattcttgttgaattgatccctttacaattatgtaatggccttctttgtctcttttgatctttgttggtttaaagtctgttttatcagagactaggattgcaacccctgctttttttgttttccatttgcttggtagatcttcctccatccctttattttgagcctatgtgtgtctctgcacatgagatggatttcctgaataagcacactgatgggtcttgactctttatccaatttgtcagtctgtgtcttttaattggagcatttagcccatttacatttaaggttaatattgttatgtgtgaatttgatcccgtcattatgatgttagctggttattttgctcgttagttgatgcagtttcttcctagccttgatggtctttacaatttggcatgattttgcagtggctggtaccggttgttcctttccgtgtttagtgcttccttcaggagctcttgtagggcaggcgtggtggtgacaaaatctctcagtatttgcttgtctgtaaagtattttatttctccttcacttaggaagcttagtttggctggatatgaaattctgggttgaaaattattttctttaagcatgttgaatactggcccccactctcttctggcttgtagagtttctgcagagagatccgctgttaatctgatgggcttccctttgtgggtaaccccacctttctctctggctgcccttaacattttttccttcatttcaactttggtgaatctgacaattatgtgtcttggagttgctcttctcgaggagtatctttgtggtgttctctgtatttcctgaaactgaatgttggcttgccttgctagattggggcagttctcctggataatatcctgcagagtgttttccaacttggttccattctccccgtcactttcaggtacaccaatcagacgtagatttggtcttttcacatagttccatatttcttggaggctttgttcgtttctttttattcttttttctctgaacttcccttcttgcttcatttcattcatttcatcttccatcactgataccctttcttccagttgattgcttcggctcctgaggcttctgcattcctcacgtagttctcgagccttggctttcagctccatcagctcctttaagcacttctctgcattggttattctagttatacatttgtctaaatttttttcaaagtttttaacttctttgcctttggtctgaatttcctcctgtagctcggagtagtttgatcgtctgaagccttcttctctcaactcgtcaaagtcattctccatccagctttgttccgttgctggtgaggaactgcgttcctttggaggaggagaggcactctgctttttagagtttccagtttttctgctctgttttttccccatctttgtggttttatctacttttggtccttgatgatggtgatgtacagttgggtttttggtgtggatgtcctttctgtttgttagttttccttctaacagacaggaccctcagctgcaggtctgttggagtttgctagaggtccactccagaccctgtttgcctgggtacccgcagtggtggctgcagaacagcagattttcgtgaaccgcgaatgctgctgtctgatcattcctcgggaagttttgtctcagagaagtacccggccggccgtgtgaggtgtcagtctgcccctactcgggggtgcctcccagtcaggctgctcgggggtcaggggtcagggacccacttgaggaggcagtctgcccgttctcagatctccggctgcatgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgggctccacccagttcgagcttccctgctgctttgtttacctaagcaagcctgggcaatggcaggcgcccctcccccagactcactgccgccttgcagtttgatctcagactgctgtgctagcaatcagcgagactccgtgggcgtaggaccctcccagccaggtgtgggatatagtctcctggtgtgcctttttttaagccggtcagaaaagtgcagtattagggtgagagtgacccgattttccaggtgccgtctgtggcccctttctttgactaggaaagggaactccctgatcccttgcacttcccgagtgaggtaatgcctcgccctgctttggctggcacacggtgcgctgcacccactgtcctgtgcccactgtctggcactccctagtgagatgaactcggtacctcagatggaaatgcagaaatcacccgtcttctgcgttgctcacgctgggagctgtagaccagagctgttcccattcggccatcttggctc

SEQ ID NO: 12647 - DNA, 6058 bp, Homo sapiens
attttgtggtaagttttcttttttttttttaagaaaattttttttttattatactttaagttttagggtacatttgcaccttgtgcaggttagttacatatgtatacatgtgccatgctggtgcactgcacccactaactcatcatctagcattaggtatatctcccaatgctatccctcccccctccccccacccaacaacagtccccagagtgtgatattccccttcctgtgtccatgtgatctcattgttcaattcccacctatgagtgagaatatgcggtgtttggttttttgttcttgcgatagtttactgagaatgacgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaactgttcctatttctgcacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgttttcttttgagaagtgtctgttcatgtccttcgcccactttttgatggggttgtttgtttttttcttgtaaatttgtttgagttcattgtagattctggatatgagccctttgtcagatgagtaggttgcgaaaattttctcccattttgtaggttgcctgttcactctgatggtagtttcttttgctgtgcaggagctctttagtttaattagatcccatttgtcaattttggcttttggtgccattgcttttggtggtttagacatgaagtccttgcccatgcctatgtcctgaatggtattgcctaggttttcttctagggtttttatggttttaggtctaacatttaagtcttaaatccatcttgaattgatttttgtataaggtgtaaggaaaggatccagtttcagctttctacatatggctagccagttttcccagcaccatttattaaatagggaatcctttacccattgcttgtttttctcaggtttctcaaaaatcagatagttgtagatatgcggcgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgcttgtatcctcttttatttccttgagcagtggtttgtagttctccttgaagaggtccttcacatcccttgtaagttggattcctaggtatttgattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttggcttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcttggtggataagctttttgatgtgctgctggattcggtttgccagtattttactgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagggtgtatgtgtcgaggaatttatccatttcttctagattttctagtttatttgcatagaggtgtttgtagtattctctgatgatagtttgtatttctgtgggatcggtggtgatatcccctttatcattttttattgtgtctatttgattcttctctctttttttctttattagtcttgctagcggtctatcaattttgttgatctttcaaaaaaccagctcctggattcattaattttttgaagggttttttgtgtctctatttcctgcagtctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggtttggagtgagattcttaatcctgagttctagtttgattgcactgtggtctgagagagagtttgttataatttctgttcttttgcatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcgcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaatattgcaacccctgcctttttttgttttccatttgcttggtagatcttcctccatccttttattttgagcctatgtgtgtctctgcatgtgagatgggtttcctgaatacagcacactgatgggtcttgactctttatccaacttgccagtctttgtcttttaattggagcatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttctcctttgcttatgaagcttagtttggctggatgtgaaattctgggttgaaaattcttgtctttaagaatgttgaatattggcccccactctcttctagcttgtagggtttctgctgagagatccgctgttagtctgatggctcacctatgaggtaacccgacctatctctctggctgccctaaacatgtgctccttcatctcaactttggtgaatctgacagttatgtgtcttggagttgctcttctcgaggagtatctatgtggcgttctctgtatttcctgaatctgaacgttggcctgccttgctagattggggaagttctcctggataatatcctgcagagtgttttccaacttggttccattctccccatcactttcaggtacaccaatcagacgtagatttggtctttcacatagtcccatatttcttggaggctttgctcatttgtttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaattttttccaaagtttttcaacttctttgcctttggtttgaatgtcctcccgtagctcagagtaatttgattgtctgaagccttcttctctcagctcgtcaaagtcattctccatccagctttgttccgttgctggtgaggaactgcgttcctttggaggaggagaggcgctctgctttctagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtactgggccctgtgaggtgtcagtctgcccctgctggggggtgcctccctgttaggctgctcaggggtcaggggtcagggacccacttgaggaggcagtctgccggttcccatatctccagctgtgtactgggagaaccactgctctcttcaaagctgtcagacagggacatttaagtctgcagaggttactgctgtctttttgtttggctgtgccctgcccccataggtggagcctacagaggcaggcaggcctcctggagctgtggtggctccacccagttcgagctttaggctgctttgtttacctaaggaagcctgggcaatggcgggcgcccctcccccagcctcgctgccgccttgcagtttgatctcagactgctgtgctagcaatcagtgtgactccgtggggtaggaccctccgagccaggtgcgggatataatctcgtggtgcgccgttttttaagcgggtctgaaaagcgcaatattcgggtgggagtgacccgattttccaggtgccgtccgtcacccctttctttgactcggaaagggaactccctgaccccttgctcttcccaagtgaggcaatgcctcgccctgcttcggctcgcgcacggtgcacgcacccactgacctgcgcccactgtctggcactccctagtgagatgaacccggtacctcagatggaaatgcagaaatcacccatcttctgcgtcgctcacgctgggagctgtagaccagagctgttcctattcggacatcttggctcctccc

SEQ ID NO: 12648 - DNA, 10342 bp, Homo sapiens
ttttttttttttttttttttttttttttttttttttttttttttgagacggagtctcgctctgtcgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggcctaaactttcaatttttaaaaaaactttttaactctcttgtaggaacacttagcttaaaacacaaacacattgtacatctatatacattttttttttttttgagatggagtttcgcttttgttgcccaggctggagtacaatggcatgaactcggctcaccacaacctccacctcctgggttcaagcaattctcctgcctcagcctcccgactagctgggattacaggcatgcgccaccacacccagctaattttgtatttttagtagagatgaaatttccccatgttggtcaggctggtcccgacctcaggtgatccgccctcctcagcctcccaaagtgctgggattacagacgtgagctaccactcctggccccccccccaattttttttatagccttgttctacaagtttttttttttaattttttaaatttttaacattttaagcatttttgttaaaaatgaagacacaaacataatagcctatccagggtcaacatcatcaatatcatcgtcttccacttccacgtcttgtcccactggaaggtcttctggggcagtaacatacatggagctgtcatttcctaggataacagtgctgccttctggaaaacctccttaaagggcctgcctgaggctgttttacagttaacatttttttaaataagtagaaggagtaagtctacaataacaataaaagcattgcataataaatacatgagccagtaacagtcacttattaaatattacataatgtacataattgtatgtgttacacttttatgtaacaactttaagcactgtttacaccagtatcaccacaaacatgtaatgggttacactacagccttacagtggctaccacgtcactaagctataggaatgaatgaatgaatgaatttatttatttaagacagggtctcgctctgttgccaggactgcagtgcagtggtgctatctcggtccactgcaacttctgcttcctgggttcaagtgattcttatgcctcagcctcccaagtagctgagactacaagcgtacaccaccatgcctggctaatttttggatttttagtagagatatggttttgtcatgttggccaggttggtctggaactcctggcctcaagtggtcctcctgccttggcctcccagagtgctgggattacaggcatgagccactgcgcccaactgaaatattttagtttcattatagtcttacgggaccactgtggtatatgaggtctgttgttcactgaaatgttctgtggtacatgattgtacatgattgtgtgctataaaaatttaacatttgaccagttatcactgcccgctccctcactttttggaaggctaaaattatcaatgattttctagggtttcacttctgtatataactaaagcagtgtttaatgacagggaatttggggctgagtctgtggtataattctaaattgtaatgtgtcatttttatgtttttgattttgttttaatagaaagcttttgatgtaaaaactattttaactttacatcaatgtgtattatcctgtgaaaatgttttgaagatacttagatctatggttgaagatacagatgctttgtattatgtttcagatatgagcaagacagtgggcatgacagtggaagtgaggatgcctgttttgattcttcacaaccatttaccttagttactataggcatgcagaaattttttatacccaagtcacctacttcttctaatgaacctgaaaatagagttctccctatgccaacaagtattgggattttccttgactgtgataaaggcaaagtaaatttctatgatatggatcagatgaaatgcctttatgaacgccaagtggactgttcacatacactgtatccagcatttgcattaatgggcagtggaggaattcagcttgaagaacccatcacagcaaaatatctggaataccaagaggacatgtagttgaaacatctgatgtgactcaggataaaaactgtaaacaaagcaatgccttagcgttaaccttcgtaactaattacatatcgctgagtgttctgtcaccccacttgtgtttgagtatgattcttcttgaaatacagaaaatctaaacagccttgtgtcttcatgtcgttgttctgcctttcacaaatgatgaaagtgaagatgttctttccaagttaatactgaagtggttaactttgcaactggactgtcttttactttatgtacaggatatctaatttatttctgtcagctggtgttgctgacactttccttatggtgggggggatacaaaagtatttattatgattctcttctgtttgacttttcatttttatatcatgtttatgtcctaagagaagatattttttaaatgccttatggataggaattagtactaagcaatgtgtcttgcatttgttttcaataggaaaacaaagttctagataggttaaaagaaaaacaccataaaagtggtagtatatttaagtggaaaattatgtattttaaagtgtgtaactattaaaaatatattgcctggaaaaggaatactactgttttgttttgttaagaccacaaactgtattgctaaggacattttaagagtctgcttagccataacactcatttaacagcatgggtagtaagcatggtttcttgcagaaaacacaaagttctcagctaacacattaaacttctcactttatatactttttttcagagaaatttatctttagtttttcttattctgtgaaaatatttgttcttatgtcaaagaattatttttcagatatattggtaaagatggactgatattaaaagtcatatttattcttttacccccttactgtgttttgtgattttcatttttggcccaattattacatatcaggttttcctgatttatatttacatgtttgaaaagttcattatatattttagtagcgttacatatattataaatttttgtaacatttaaatgttcacttatgtggcattttctgtttctcattggtaataagcatttctaatataagcaagtaaaaatacaaatttaattacttagaaatgataactaagatcacaatgactgtgtaccctttaaaatatcttttaatttgaggaattacattctatctaaattgtgtgtctgtttttgaaaggtgttgctttcaagtaggtggtttttatttaaagtacttatttttttgaggttaaaatattcagaaactacttttatgcattgtagcagtaatcatttatggaatgcttttgacatgttttaacagggtaaccaaaacttttaggcctgttttttttggttgtccttgttgttatatttttaatggaaatctgttactcaggctggtagcattaaattagctttttaccctcaactcaagtagcaaatatcatggagaacttcagtgtttagcaggctgttaatttcccatctatgaatagcactttatgatgtaggctaaactaagcaaataatgcagcgttatgtggatcattatgcaataaagctgctaaagtcacatttgtggttgatactcaagccttgtacaagcacatatcatgtagacatttttaaatgtgaagctttaacaggaataggatagctgtttcaaaccttgtgcaattgtaaataaattgtttagctgtgtttctttcatttttaataaaaaattaaaaagaattcatgtgtaattattcagatctgcattccaggaatttttagtatgtttacatgaaaagttgaaacaaactgattatgaaaagatgattagctgtacatattaactcagagctacagttttatatgaaatcattttgaacatttatttattagcttaatttctgtgaaagtgattattagagaagcttaacataaaacttcaattgtttcatatattaaatttttttaatataaaacaatataaaattttatttttttattacataagctaataataatagtgcaagtttgttcttttatccccaaaggaaaaatatggtaaaagttatatcttgactaaggatctgagggtcaacattttaataccaaaatgctgtgtttataattaatatattcaaaatatactcatctttaaaccaaatgttatatactaaaagacatcagaaagtatctactaaatagtacaatatagtaaccaccttgtaacactgtacttaatatagcccagttttataaaatactgtaaatagttctaccgtctaagcaattctagattttatttttccctttgtgcaacaaatcagaatgcgtgattatagaatgctaaaagctcttggagatactttgccaggcatctttgaggagaaattttagagaatcaacgacacttgattaagcatttatgaaccataagtttttcttctgctctcctgtggaaaaaaaacaaacataaaataaaacaacaaaccatattggcaattgcatatgtttataaacattccattattttttttttctgttttaattatcttttaagatgaaataatctgtccataggctagagcagcaagtttatgcaagagaatatgaaaacatccttccttctagtagaatatgtatccatagtgcatgatgtccactgaagtttgtaatatttttacatgcaatgttactattgcagttattaacaacctataatgttttgcacatagtaggctttcaaatgctgttaggattcaacatgggacataaagcctaagaatggaaccagattccctagggtttcagtatttgatttctagatgactagaagactgccctggtgtaatctatgtgtcttggaatttttttatggtgatgaacaaagtaaacatttgacctggaaatcactggaaatattcgaaccaaacaaaagagtaataaaaagtaaacctatccttaactttaaaaccaagcatgggttcttctggttgatgggtgtatagttgagaaagcatatttctccagaactattcagtttcactgacagggaagtattttttggcacaataaccaattattgaattattttattttattttattttattatactttaagttctagggtacatacgcacaacacgcaggtttgttacatatgtttacatgtgccatgttggtgtgctgcacccattaactcatcatttacgttatgtatatctcctaatgctatccctctcccctcccccacaccccacaacaggccccggtatgtgatgttccccaccctgtgtccaagtgttctcattgtgcatttcccacctatgagtgagaacatgtggtgtttggttttctgtccttgcgatagtttgctcagaatgatggattccagcttcatccatgtccctacaaaggacatgaactcatccttttttaatggctgcatagtattccatggtgtatatgtgccacattttctttatccagtctatcattgatggacatttgggttggttcccagtccttgctattgtgaatagtgccacaataaacatacgtgtgcatgtttctttatagtagcatgattgataatcctttgggtttatgcccagtaatgggatggctgggccaaatggtatttctggttctagatccttgaggaattgccacactgacttccccaatggttgaactagtttacagtcccatcaacagtgtaaaagtgttcctatttctccacatcctctccagcacctgttgtttcctgactttttaatgattgccattctaactggtgtgggatggtatctcattgtggttttgatttgcatttctcagatggcgagtgatgatgagcattttttcatgtgtctgttggccacataaatatcttcttttgagaagtgtctgttcatatcctttgcccactttttgatggggttgtttgattttttcttgtaaatttgtttaagttctttgtagattctggatattaaccctttgtcaggtgggtagattgtaaaaattttctcccattctgtaggttgcctgttcactctgatagtagtttcttttgctgtgcagaagctctttagtttacttagatcccattagccaattttggcttctgttgccattgcttttggtgtttaagtcatgaagtccttacccatgcctacgtcctgaatggtaatgcctaggttttcttctagggtttttatggttttaggtctgacatttaagtctttaatccatcttgaattaatttttgtataaggtgtaaggaagggatccagtttcagctttctacatatggctagccagttttcacaacaccatttgttaaatagggaatcctttccccatttcttgtttttgtcaggtttgtcaaagatcagatggttgtagatgtgtggtattatttccaacgactctattctgttccattggtctatgtctctgttttggtaccagtaccatgctgtttttgttactgtagacttgtagtatagtttgaagtcaggtggcatgatgcctccagctttgttcttttggcttaggattgtcttggaaatgtgggctcctttttggttccatatgaactttaaagtagttttttccaattctgtgaagaaagtcatttggtagcttgatggggatggcattgaatctataaattaccttgggtggtatggccattttcacaatatttattcttcctatccatgagaatggaatgtccttccatttgtttctgtcctcttttatttcgttgagcagtggtttgtaattctccttgaagaggtccttcacatcccttgttggttggattcctaggtattttattctctttgaagcaattgtgaatgggcgttcactcctgatttggctctctgtctgttaatggtgtataggaatgcttgtgatttttgcacattgattttgtatcctgagactttgctgaagatgcttatcagcttaaggagattttgggctgagatgatggggttttctaaatatacaatcatgtcatctgcaaacagggacaatttgacttcctcttttcctaattgaataccctttatttatttctcctgcctgattgccctggccagaacttccaacactatgttgattaggagtggtgagagagggcatccctgtcttgtgccaggtttcaaagggaatgcttccagtttttgcccattcagtatgatattggctgtgggtttgtcataaatagctcttattattttgagatacgtcccatcaatacctaatttattgagagtttttagcatgaagggctgttgaattttgtaaaaggccttttctgcatctattgagataatcacgtggtttttgtctttggttctgtttatacaatggattatgtttattgatttacatatgttaaactggccttgcatcccagggatgaagctagcttgaccgtggtgaataggcttttttatgtgctgctggattcggtttgccggtattttatcgaggatttttgcatcgatgttcaacagggatattggtctaaaattctctttttttgttgtgtttctgccaggctttggtatcaggatgatgctggcctcataaaatgaattagggaggattctctctttttctattgattggaatagtttcagaagcaatggtaccagctcctctttgtacctctgatagaattcggctgtgaatccatctggttctggactttttttgattggtaggctattaattattgcctcaatttcagaacctgttattagcctattcagggattcagcttcttcctggtttagttttgggagggtgtatgtgtccaggaatttacccatttcttctagattttctagtttatttgcatagaggtgtttatagtattctctgatggtagtttgtatttctgtgggattggtgatgatatcccctttatcattttttattgcatctatttgattcttctctcttttcttctttattagtcttgctagcggtctatcaattttgtagatgttttcaaaaaaccagctccttggattcattgattttttgaagggttttttgtgtctccatctccttcagttctgctctgatgttagttagttcttgccttctgctagcttttgaatgtgttttctcttccttctctagttcttttaattgtgacattagggtgtcaattttagatctttcctgctttctcttgtgggcatttagtgctataaatttccctctacacactgctttgaatatgtcccagagatgctggtatgttgtgtctttgttctcattggtttcgaagaacatctttatttttgccttcatttcattatgtacccagtagtcattcaggagcaggttgttcagtttccatgtagttgcgcggttttgaatgagtttctcaatcctgaattctagtttgattgcactgtggtctgagagacagtttgttataatatctattcttttacatttgctgaggagtgctttacttccaaccatgtggtcaattttggagtaagtgtgatgtggtgctgagaagaatgtatattctgttgatttggggtgaagagtcctgtagatgtctattagaccctcttagtgcagagctgagttcaattcctggatatccttgttaactttctgtctcgttgatttgtctaatgttgacagtgaggtgttaaagtctcccattattattgtgtggtagtctaagtctctttgtaggtctttaagggcttgctttgtgaatctgggttctcctgtattgggtgcatatatatttaggatagttagctcttttcttgttgaattgatccctttacgtttatgtaatggccttctttgtctgttttgatctttgttggtttaaagtctgttttatccaagactaggattgcaacccctgcctttttttgttttccattttcttggtagatcttcatccgtttattttgagcctatgtgtgtctgtctgcatgtgagataggtctcctgaatacagcacactgatgggtcttgactctttatccaatttgccagtctgtgtcttttaattgtagcatttacctcatttacatttaaggttaatattgttatgtgtgaatttgatcctgtcattatgatgttagctggttgttttgctcattagttgatgcagtttcttcctagcctccatggtctttacaatttcgcatgtttttgcagtggctggtaccagttgttgctttccatgtttagtgcttccttcaggagctcttgtaaggcaggcctggtggtgacaaaatctttcagcatttgcttgtctgtagaggattttatttctcttccacttacgaagcttagtttggctggatatgaaattctgggctgaaaattcttttctttaagaatgttgaatattggcccccactttcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttctcgaggagtatctttgtgacattctctgtattcctgaatttgaatgttggcctgccttgctaggttgtgaaagttctcctggataataccctgaagagtgttttccaactgggttccattctccccatctctttcagttacaccaatcagatgtagatttggtcttttcacatagtcccatatttcttggaggctttattcatttctttttacttttttctctaaacttctcttcttgcttcatttcattcatttgctcttcagtcactgataccctttcttccacttgattgaattggctactgaagcttgtgcatgtgtcacgtagttcttgtgccatggttttcagctccatcaggtcatttaaagacttctctacactgtttattctagttagccattcgtctactcttttttcaaggtttttagcttctttgcgatgggttcgaa

SEQ ID NO: 12649 - DNA, 6055 bp, Homo sapiens
attaatagataatatttttttttaaatttttttttaattatactttaagttttagagtacatgtgcacattgtgcaggttagttacatatgtatacatgtgccatgctggtgtgctgcacccactaactcgacatctagcattacgtatatctcccaatgctatccctcccccctccccccaccacacaacagtccccagagtgtgatgttccccttcctgtgtccatgtgatctcattgttcaattcccacctatgagtgagaatatgcggtgtttggttttttgttcttgcgatagtttactgagaatgattatttccaatttcatccatgtccctacaaaggacatgaattcatcattttttatggctgcatagtattccatggtgtatatgtgccatattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttgactctgatggtagtttcttttgccgtgcagaagctctttagtttaattagatcccatttgtcaattttgtcttttgttgccattgcttttggtgttttagacctgaagtccttgcccatgcctatgtcctgaatggtaatgcctaggttttcttctagggttttgatggttttaggtctaacgtttaagtctttaatccatattgaattgatttttatataaggtgtaaggaagggatccagtttcagctttctacatatggctagccagttttcccagcaccatttattaaatagggaatcctttccccattgcttgtttttctcatgtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagtattttccaattctgtgatgaaacgcattggtagcttgatggggattgcattgaatctgtaaattaccttgggcagtatggccattttcacgatattgattcttcctacccatgagcatggaatgttcttccatttgtttgtatcctcttttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatactgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaggttgttgaattttgtcaaaggccttttctgcatctattgagataatcatgcggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttgtttgtgtctctgcccggctttggtatcagaatgatgctggcctcataaaatgagttagagaggattccctctttttctattgattggaatagtttcagaaggaatggtaccagttcctccttgtacctctggtagaattcggctgtgaatccatctggtcctggactctttttggttgttaagctattgaatattgccacaatttcagatcctgttattggtctattcagagattcaacttcttcctggtttagtcttgggagagtgtgtgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagatcctggattcattaattttttgaagggttttttgtgtctctatttccttcagttctgctctgattttagttatttctcgccttctgctagcttttgaatgtgtttgctcttgcttctctagttcttttaattgtgatgttagggtgtcaattttggatctttcctgctttctcttgcgggcatttagtgctataaatttccctctacacactgctttgaatgagtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttagtcctgagttctagtttcattgaactgtggtctgagagatagtttgttataatgtctgttcttttacatttgctgaggagagctttacttccaagtatgtggtcaattttggaataggtgtggtgtggtgctgaaaaaaatgtatattctgttgatttggggtggagagttctgtagatgtctattgggtctgcttggtgcagagctgagttcaattcctgggtatccctgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatcttttttggtttcaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggaggatttagtccatttacatttaaagttaatagtgttatgtgtgaatttgatcctgtcattatgatgttagctggttattttgctcattagttgatgcagtttcttcctagtctcgatggtctttacattatggcatgattttgcagcggctggtaccagttcttcctttccatgtttagcgcttccttcaggagctcttttagggcaggcctggtggtgacaaaatctctcagcatttgcttgtctgtaaagtattttatttctccttcacttgtgaagcttagtttggctggatatgaaattcttggttgaaaattcttttctttaagaatgttgaatattggcccccactctcttctggcttgtagggtttctgctgagagatccgctgttagtctgatgggcttccctttgagggtaacccgacctttctctctggctgcccttaacattttctccttcatttcacctttggtgaatctgacaattatgtgtcttggagttgctcttctcgaggagtatctttgtggtgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttcaaggctttgcttgtttctttttattcttttttctctaaactttccttcttgcttcatttcattcatttcatcttccattgctgataccctttcttccagttgatcacatcggctcctgaggcttctgcattcttcacgtagttctcgagccttggttttcagctccatcagctcctttaagcacttttctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccgtccagctttgttccattgctggtgatgagctgcattcctttggaggaggagaggcactctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccgtgtgaggtgtcagtgtgcccctgctggagggtgcctcccagttaggctgctcaggggtcaggggtgagggacccacttgaggaggcagtctgcctgttctcaaatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttctgggctgctttgtttacctaagcaagcctgggcaatggcgggcgcccctcccccagcctcgctgccaccttgcagtttgatctcagactgctgtgctagcaatcagcgagactccgtgggcgtaggaccctctgagccaggtgcaggatataatctcgtggtgtgctgttttttaagcccgtcggaaaagcgcagtattcgggtgggagtgacccgattttccaggtgccgtccgtcacccctttctttgattaggaaagggaactccctaaccccttgcgcttcccgagtgaggcaatgcctcgccctgctttggctcacgcacggtgcgcgcacccactgacctgtgcccactgtctggcactccctagtgagatgaacccggtacctcagatggaaatgcagaaatcacccgtcttctgcgtcgctcaggctgggagctgtagactggaactgttcctattcggccatcttggctcctcccca

SEQ ID NO: 12650 - DNA, 6052 bp, Homo sapiens
ttgtttttgtttttttgttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtcaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaatgttctcccattttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttctataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgacattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactatgctgaagttgcttatcagcttaaggagattttgggctgagacgatgggcttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagagatgaagcccacttgatcatggtggataagctttttgatgtgctgctggattcggtttgccagtattttattgaggatttttgcatcaatgttcatcaaggatattggtctaaaattctcttttttggttgtgtctctacccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatgtctgtgggatcggtggtgatatcccctttatcattttttattgtgtctatttgattcttctctctttttttctttattagtcttgctagtggtctatcaattttgttgatgctttcaaaaaaacagctcctggattcattgattttttgaagtgttttttgtgtctctatttccttcagttctgctctgattttagttatttcttgccttctgctagcttttgaatgtgtttgctcttgcttttctagtacttttaattgtgatgttagggtgtcaattttggatctttcctgctttctcttgtgggcatttagtgctatacatttccctctacacactgctttgaatgcgtcccagagattctggtatgctgtgtctttgttctcgttggtttcaaagaacatctttatttctgccttcatttcgttatgtacccagtagtcatttaggagcaggttgttcagtttccatgtagttgagcagctttgagtgagattcttaatcctgagttctagtttgattgcactgtggtctgagagatagtttgttataatttctgttcttttacatttgctgaggagagctttacttccaagtatgtggtcagttttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcctattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtcttcacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttgtctctaaacttcccttctcgcttcatttcattcgtttcatcttccattgctgataccctttcttccagttgatcgcatcggctcctgaggcttctgcattcatcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcccagctgctttgtttacctaagcaagcctgggctatggcaggcgcccctcccccagcctcgctgccgccttgcagtttgatctcagactgctgtgctagcaatcagcaagactccgtgggcgtaggaccctccgagccaggtgtgggatatagtcttgtggtgcgccgtttttaaagccggtctgaaaagcgcaatattcgggtgggagtgacccgattttctaggtgcctccgtcacccctttctttgactcggaaagggaactccctgaccccttgcgcttcccaggtgaggcaatgcctcgccctgcttcggctcgtgcacgttgcgcacacccactggcctgcgcccactgtctggcactccctagtgagatgaacccggtacctcagatggaaatgcagaaatcacctgtcttctgcgtcgctcacactgggagctgtagaccggagctgttcctattcggccatcttggctcctcctctat

SEQ ID NO: 12651 - DNA, 41345 bp, Homo sapiens
  misc_feature (19396)..(19396): n equals a,t,g, or c
  misc_feature (19398)..(19398): n equals a,t,g, or c
ttttttttaatttattttttattattatactttaagtttcagggtacatgtgcacattgtgcaggttagttacatatgtatacatgtgccatgctggtgtgctgcacccactaattcgtcatctagcattaggtatatctcgcaatgctatccctcccccctccccctaccccacaacagtccccagagtgtgatattccccttcctgtgtccatgagatctcattgttcaattcccacctatgagtgagaatatacggtgtctggttttttgttcttgcgatagtttactgagaatgatgatttccagtttcacccatgtccctacaaaggacataaactcatcattttttgtggctgcatagtattccatggtgtatatgtgccacattttcttaatccagtctatcattgttggacatttgggttggttccaagtctttgttatggtgaataatgccgcaataaacatacgtgtgcatgtgtctttatagcagcatgatttatagtcctttgggtacatacccagtaatgggatggctgggtcaaatggtatttcctgttctagatccctgaggaatcgccacactgacttccacaatggttgaactagtttacagttccaccaacagtgtaaaagtgttcctatttctccacatcctctccagcacctgttgtttcctgactttttaatgattgccattctaactggtgtgagatggtgtctcattgtagttttgatttgcatttctctgaaggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtggcagtaccacgctgttttggttactgtagccttgtagtatagtttgaagtcaggtagtgtgatacctccagctttgttcttttcgcttaggattgacttggtgatgtgggctcttttttagttccatatgaactttaaagtagttttttccaattctgtgaagaaaggcattggtagcttgatggggatggcattgaatctgtaaattaccttgggcagtatggccattttcacaatattgattcttcctacccatgagcatgggatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgtggttggtgtataagaatgcttgtgatttttgtacattgattttgtatcctgggactttgctgaagttgcttatcagcttaaggagattttgggctgagacaatggggttttctagatatacaatcatgtcgtctgcaaacagggacaatttgacttcctcttttcctaattgaataccctttatttccttctgctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaatggttgttgaattttgtcaaaggctttttctgcatctattgagataatcatgtggtttttgtctttggctctgtttatatgctggattacatttattgatttgcgtatattgaaccagccttgcatcccagggatgaagcccacttcatcatggtggataagctttttgatgtgctgctggattcgttttgccagtattttattgaggatttgtgcatcgatgttcttcaaggatattggtctaaaattctctttttttgttgtgcctttgcctggctttggtatcagaatgatgctagcctcataaaatgagttagggaggattccctctttttctgttgattggaagagtttcagaaggaatggtactagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatttgtcgaggaatttatccatttcttctagattttgtagtttatttgcgtagaggtatttgtagtattctctgatggtagtttgtatttctgtgggatcggtggtgatatcccctttatcattttttattgtgtctatttgattcttctctctttttttctttattagtctggctaacggtctatcaattttgttgatcctttcaaaaaaccagctcctggattcattaattttttgaagggttttttgtgtctctatttccttcagttctgctctgattttagttatttcttgccttctgctagcttttgcatgtgtttgctcttggttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaatatctttatttctgcctttatttcgttatgtacccagtagtcattcaggagcaggttgttcagtttccatgtagttgagcgcttttgaatgagattcttaatcctgagttctagtttgattgcactgtggtctgagagatagtttgttataatttctgttcttttacatttgctgaggagagctttacttccaagtaagtggtcaattttggaataggtgtggtgtggtgctgaaaaaaatgtatattctgttgatttggggtggagagctctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgcccctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatctttctccatccttttattttgagcctatgtgtgtctctgcacgtgagatgggtttcctgaatacagcacactgatgggtcttgactttttaatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatatttagcgcttccttcaggagctcttttagggcaggcgtggtggtgacaaaatctctcagcaattgcttgtctgtaaagtattttatttgtccttcacttatgaagcttagtttggctggatatgaaattctgggttgaaaattcttttctttaagagtgttgaatattggcccccactctcttctggcttgtagggtctctgccgagagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagcgtgttttccaacttggttccattctccccatcactttcaggtacaccaatcagacgtagatttggtcttttcacatagtcccatatttcttggaggcttttctcatttctttttattcttttttctctaaacttcccttctcgcttcatttcattcatttcatcttccattgctgataccctttcttcctgttgatcgcattggctcctgaggcttctgcattcttcacgtagttctcaagccttggttttcagctccatcagctcctttaagcacttctctgtattggttattctagttatacattcttctaaattgttttcaaagttttcaacttctttgcctttggtttgaatgtcctcccgtcgctcacagtaatttgattgtctgaagccttctactctcagctcgtcaaagtcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttatgtttgttagttttccttctaacagagaggaccctcagctgcaggtctgttggagtaccctgccgtgtgaggtgtcggtatgcccctgctggggggtgcctcccggttaggctgctcgggggtcaggggtcagggacccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttcgagcttcctggctgctttgtttacctaatcaagcctgggcaaaggcgggcgcccctcccccagcctccctgccaccttgcagtttgatctcagactgctgtgctagcaatcagcgagactccctgggcgtaggaccctccgagccaggtgcaggatataatcttgtgatgcgccgtttttcaagccggtcggaaaagcacagtattcgggtgggagtgacctgattttccaggtgctgtccgtcacccctttttttgactcggaaagggaactccctgaccccttgcgcttcccaagtgaggcaatgccttgccctgcttcggctcgtgcacggtgtgctcacccactgacctgcgcccactgtctggcactccctagtgagatgaacccggtacctcagatggaaatgcagaaatcacccgtcttctgcgtcgctcacactggtagctgtagaccggagctgttcctattcggccatcttggctcctccaggtgaacagatttttattttgaaattctaatccacaaattaggtccaagtttgggtctcagaaatctgtgtttctaccaaacactgcaaatctcccctttcattagggaagttgtaataaatactgatgtaggctcattggtgtgtggcaaaccatagtggcttgtatcagtccaggagtgggttagtgacttaaattagtccgaggtgatagatggcaaggtcttatagttcagggtttttgagagaggattttcttcctactgtttttcctgaacaaagacacgtacagccccagttattggtgtcagccattttatgaaagtgaggagaattagccttaggatgaagaaagtgtgtgtttgtgagagcagaaacagaaaatgaatcagaaatcttaataacaaaatgagccatcaatcaactaaatccaatgcctgcactggccctggacttttattatgtgacaagtggttttcttatttgttaagcaagttgtatttcctgttctttgctgttagaagctttctaatttcacctaattgtgatttttttcaaaagattttttttttactttagaaaaaaaatctaggaaaagtatttcccaattttctgctattattaagtaaaattaaggtattagtctacatcatttctctctgataataaatttggaatccaggaaggaacaatcaattttttgcaattatgtgacggataccacttcaggatcaatatcttcaactcttatgtctttggtattaatcactaggaaaaaataaattattggttaataaatgtatagaagtatgcatatttgaaagtaaattcagtaaacgagactggctaaatgctagggtattcaacattctagtctatagttgtaaagttgagaattaattttcccatggaaaaatgaaatgaaatattttattaaaatattcacacatatatgtgatgctcattttagctgtgggataggcttccgggcaaagcctctgttggctctgggtgggacaggtgtcacatttcctgcagatatccaattgaatttgggtgcttacatactactgctagccagagcttgtggtgtccttccttttaaatgctgttttgtatccagtaggttacacataagactggtaagtttctccagaagtaaaaagggactagaaactcaaccttcctccccataagttttatatataaatatacatttgctggatgagagtggcagctgttaacatattgcaagaaagacaatagagtttctaaataaggagtctgaacctatgtgaagatttggaggcaaagcctaaggtttggaaaggaattgtggttccctattccatgtaaaactggcaccaggacttaatttagtcagcctgactgcaagaatgcaccttaggggaaatgcatgcacaggcatgcacaagtgtgtgtgcctgtgtatcttcatgcctttgcatccataggtaacctataacactttggggcctgtgcagcttagtgaaggacactctgagcatagcagaagaaaggctccacaggtatcctcagttgttagctaaagctgaactattttccacgcaattatcattgagacaattgttttggagcccaacctcagggagtttaaattcctactctatcaatgagtactaagggtgaccagaaatgatttataggttggagtcttaggaacagtaacaaattgaaactgtaagaacatattagaatttctgctagtcaaacaggatgagagaaacataagattttgaaggactaatataaatatcttattgctattataagctgataaaacccaggacatgctaattatgcttacaggacaaggtggcatatatgaactgccctgcctagaactttcccccaactcagtccttaaaacttaccccaggagctaatagaatgttagatgcagactggcaagcaaagattcactcaccagagttagagagcgcttcgtagggtttcaggtgtgaggaaagtaggattggcaggtgagctaaacaagcaaaagtagtacttccctccctgatccctgaactagagaaaagagaaagttgctaaagacaaactgttacaagaagcatatgaaccaggcgtccttgaataacttctttcctaaccccaccaatagcactggaatacagaggaacacaaaaaaattttccctgtgatttggggaatttcagtggaactttgacatttttgagggtggcttttgtgtacagaaaatataacttggaggcttctttatcttttaaaattattacttatttcattgatatttcagattaagtcctagttcttccttaaactttgaagttcaaatttaaaatcttattttatttatttatatgtttattaatagctcaaattttaacatcactcttaagagagattttacaatttgtttaaattctctatttttttttcttttgtggggggcactgagtctcactctgttgcccaagctggagtgcagtggtccgatcctggctcactgcaaccttggcctcctgggttcaagcgattctcgtgcctcagtcacctgagtagctgggattataggaatgcaccagcacatcaggctaatttttgtacttttgatagaaagggggttttgccatgttggccagactggtcttgaactcctggcctcaagtgttctgcctgcctcagcctcccaaagccctgggattacaggaatgagccaccatgctgggccataaattctcttaagcattttaaacagcatttacaaatttagtatatttaattttctctttaagtagttcgtccaacaagtgaattttctcaaagtaccaaaatatatctggtaaatctaatgaattgaacttagtaattaattataataatgtttaaatctcttaaacattctaaactgttttcacatgtggttgaacattatcattttcagcttaaaactgtaagtctaaatcaataattcagatatataaattgaaacataagtctgatcttttaagtgttctaatattctaaattatcttaaatattaagaacaattaaaacaataaatatataaagattattccaaaagctaacataaaatatttctattatcagtgttattttcatttccatttctagtttttatttctcaaaacctggtctcataacttgcagtatcaacatcacctgggaaattgttagaaatacaaattctcaggccctaccccagccctccagaaacagaaactcaggatggggcccagcaatttgtgttttaataagagttacagatgattctgatgatgcttaagtctaataactattgcatgtttaattctaaagcacttcaagggtaaggcattagtgacataaaaataaatgatcctacaatttgaggttgccttctcaaatagctttggggttaaatgctcaactggctgaagttgcatattaatgtgagatttttggccaggcaggaaatttggggcattagacatctcaggtgatctttcttgtgataatatttagggacctcatgtaaaatactctatgattcccaaacatagttattgcatagctcacatctgctagacccaaatcatatataacttattaaccaaatctaagtctgcagctctcacccgagctgcatcactgcttgattagatttagataagttgtttcttgcctgatcctagtctgattctttttatgtactttcttccctggtggagctacaatttctataggttcgtaagtgatgtcaactttaattttaatgtaatatccactttgattctgtctatctctaaagatgtgtctttctggactcagcataaacatcatgctaatagcaggaagattaaacattaaggggtaggggtaggcttgtgtgccacttttatctaaaatttaaagtggggtcttgctgtagttactcataccacaagaatggaaggggcactagcagtagagctggtgtcatagcatcgaaatgcgtgatttacagtaaaaaataatgagaatggtaaccccccagagtagtgcaacaaagcagctctacatctgagcgggagtggataggagacttcaaatttcccttcgctcctaatgagcccccagtgggtgttagaattagctgagagagcaactatagaatataggttaccagaagaaggtgacaatgttacagaagcagaggagtggaccatgaactgtgggttagaaagagactatggctcatctcagggttccaggccagggagctgacttctggttgccaatagaggaagagtggaggggttgctttcatactgagtaacacctgtgcagaagagctgacaagatgagatacatctgcagaaaatgaccggcatatgatcaagctacaccaccaccaagttgaaggaaataaaacaagaaaaaataagcaaaacccacgaagaagtatagaaggaaggaagagagtaagggagggaagaaggaatgaaggagaaaataaatagcaaaaatagtcctataactttcaataaagactttcttactttggcaatcaaaagggaccctggctcactggcttgctcccaccactaaaactgaaatgattctacacgattgtgccgatttactcgcagagctcagagcccacagttggtgttttttgttgttgttgttttttgtttttgtttttgttttttttttgctaaggatgggccttttgcaaaaaagatgaagacaaatgctagggaaactcatactgatttgctaaactaattagcctattgtgatggttaatattgagtgttaactttattgggttgaaggatgcaaagtactgttcctgggtgtgtctgtgagggtgttgccaaaggagcttaacatttgagtcagtggactcagtgagtcagaggcagatgcaaccttaatctgggtggacaccatccccttggctgccagtgcagctagaaacagcaggcagaagaaggtggagtgagcagacttgctgagtcttctggcctttatctttctcctgtgctggatgtttcctgccctcaaacaccagactccaagttcttcggcttttaggctcttggacttacactagtggtttactaggggcccttgggcttttggccacagattgaaggctgcattgtccattgcctgcttccctacttttgaggtgttgggactcggactgaaccactgctggcttccttgcttctcagctttcagacagcctatcatgggacgtcaccttgtgatcatgtgagtcaattctccttaataaactccctttcatatatatatatatgaatatgtatgtatatatatatatgaatatgtatatattcatatgtatatgtatatattcatatgtatatgtatatattcatatgtgtgtatatatatatatatctcctagtagttctgtccctctagagagccctgactaatacagattttggtagcctgtatcgtaaaatatctggaaaaagctaacagtctgaaagaaaaagactaataaagcaaccacaacagaagcaaagaaaacacgaaaagtaaaagagaatttttaaaaattagtaaatttagagaaattcaggaagacactgtgttcataatcccaagaatcagtgccatgaaaattaggtaatcagacagcaagaagaatacagaaagctacacacataattactgaaataaaatgtgagaaaggctaaactaagaaataaaaagaactgcgtagtattaatgatcagaaagaaaaagttaaggaaatttcccaggatattgatgtaaaaagaacaaaaatgctaaagtataattaagaataaaaatggaaaaagcaaataataaacattttcttgaactgaacacacacacacattcagatgtgaaggtcatacaatgtgccaagaaaaatgctccagacctggttatatcttggtaaaagttgtgaacttgaaggagaaagaaaaaatatcttaagagtttctaggacagagtgaaagattatttacaaaattcagaatcaaaccagtgtcagccttatatacagattagaatactaggaaacaaagtagggcaaagtcttcaaagtcctaaatgaaaatgctttgttgttgttgagacagggtgtcactctgtcacctaggctggggtgcagtggcaatatcacaactcactgtagtctctacctcctgggctcaagtgatcctcccacctcatcccccacctagtggctgggactacaggcactcaccacactcagctatttttttagggggggtggggtagggggagagaaaggagtctcactatgttgcccagacttatctagaactcctgggctcaagtgatcctcctgcctgtgcttcccaaaatgctgagattacaggcatgagccaccacacccagctggaaatgcttttgaacctagaattctataccatgtaatattcaaagtaagagtacaagagagagctttcaacaagcaatgagctttgaaaaattttgttttccaagcccaaatcactcatttaatcatttcaaacaatcaacagacaatcatcagagaagggaggaaagagaaagacataggaaacaaaatatctaaagcctgtagttcaataactagattaactcatttttagtgtgaaggtaattctcttgttaaaaaagtttttctaaagatgtagagatataatgtaaaaaatgtaataataatctcaattaaaattctagatagcttgaataaaaagagtggagcagggaaatagagataaaaataagccatatatagtgtattgattatatagtgttagcactagagatagtctgaattctagagtttgaaaaatatttacacacacacacacaaatatataaatatatatttagagagagagagagagagaaaggagagagagaggagagagagtccaggctggagtgcaatgtcatgatcactgcaaactctgtctaatcatctcaaaccatcctctcacctccctgagtagttgggactgcaggcactcaccaacaggcccagctaatttttgtagagatgaagtttcgccatgttgcccaggctggtctcaaactcctgagctcaagccatttgcccacttcagcctcccaaagtgctggtattacaagcgtgagccactgtacatggcatatatgtatatatatatatatatattttttttttttcctaaactgaagagtaatacattcagtcatatagtaaattcattcattaattcatcaagtacttattgaatacctgttccatgcccagcactggattcagtataggggatccgatagggagatgtggccctgcccacaaagagtttggaatacatttcagtgaattaggaatctgacatgggaagctcagggtactgtgggaccacacaggaatggtacctgacccaggcttgatgagagatagaagaggcaactaatttctttaggaaatgactcagataaaatcgggagtaggcggtgggggaagatgtatgcatgagaatgtatgcatgacactgaaagagaccatgtgctttgaaagaactgaaacacttcaggtgggttggagtataaagttcactggggtagtagcatgagatgaaactggaggggcaagcaggtgctggatcatgctgggccgtctgactgatgctggagcaatagtagtagcccttgaaagcttcttatgaaggaaagaagggtggtgtgatacgtttgcatattagaacattaactcaggttctgcataagcatggtagaaatgcttttgcctctccaaaaccaataaaattttgctataaagaattcatccaattgtgatggttaatactgagtgtcaacttgattggattgaaagatgcaaagtattgatccttgatgtgtctgtgagggtgttgccaaaggagattaacatttgagtcagtgggctaggaaaggcagacctacccttaatctgctcggcaccatctaatcagctgccagaaaatataaagcaggcaggaaaaattgaaaaggtgaggctggcctagcctcccagcctacatctttctcgtgtgctggatggtttctgccctggaacatccaacggtctccaagttcttcagttttgagactcagactggctcttcttgctcctcaagcttgcagacagcctattgtgagacctatatctatctatatttatcctattatttctgtccctctagggaaccctgtttaatacaccagtgtagcctgggtttgaaaaaaaagcttgggttttttaatttggggttcaaatctcacctccgtcacttactagctgtgtgattcaaatatgtcagttagcctctttgaggctcagtttctgtcttgttaaaagaaaaacatgaaaacacttttatcttctcttcagggcttttgtggcatcataagtgagaatttcatatgctgactgtatgtggactgttttgttccaagaagcagcagctcatctcaaaatagatgaagtcaaagagagggaattgtaagagtgcactggcatgtctctcagaagccagtggcaagaccgaagcttggtctcaggaacaactgaatcaggaatttgaaaactgtcaagatcctgtttctctcctctacacattggctttcttcttattccctaaggactgagtgtttgttttttggccatccaaaagcttggggctgtcatttcttttgttcaaagaacacccaggctgaattgtaatttcttggtttcatttccaaatttctagggagagactcttctttgctctctggtgtttgttctgcacccaattaactgtggcagtgggtgagtgtttgcactcagatgggttggagatatttctcaggagagcaatactttctcaaaaggagacataacagtcagggcctaagcagaaatcacatggcccacacaaattaggataatttaagaatgattctatagaaaatgactaattataaaaatgtaggtaaattataggaagaccatgaggtattatacacaaacctagggctagcagcatctatagacagttaaggatgaggtgagggagaatttaccagagcccaaaaggggagagttggaaagatcaggctgtcttgagaggagtagtgaccttctgtttaaggacacaggcagcccaagggagggatctgggaaatatacatcctgaccctatactttgcttcccgtatcctatctgacctctccattggccaaaactccccaagggcacaggattgtatcgatactatctatacaggtcagcttccttgggtagactgtggagtggagatggtggagagtgcactggggtataagcaaaggtaagtggacacttactactgggtctgtcctgcagctccctgagcaaaacacccttgccttgtaccccagtgcactcatacaactctccaccatggagaagctgtatgtttgtccttaagcggcatacaactacatccatatccatatccatatttcctatttagcattgactaatttcatccattgatttccagacaataaattccttttttgttgtttttaggaatgactgatgtaggtttcagttatataactgccgttgttctattgagtccatgtaaaatagatcctaattctttcagatccctagtattcaaaatatcaatggatagacttgttgaaaaattgggtaagcaagatttgtctttaaagacaagtacattaagacaaatgtttgtagaaaaaggtcatttttctgggcaattttattatatttggctaacataacttatatgtaagtgcttagtattgtattcagagtctcagtatagacattttttagaatcccaatctctcatagtttagcatctaagcgttacccacaattgattcagaatgtataaaagtataaactttattatatatgtggaaaatctctgtacatcctatgactattctaaaagtaatgaatttgtaagggagaatggaagaaaaaatgccagaaaactttaaagtgatttatctttcggaataagctttatgagaaattttaaacaaccttatttctttgttttatttaaaaatgatggccgggctcagtggctcacacttataatcccagcactttgggagtctgaggcgggcagatcacgaggtcaggagttcaagaccagcctgaccaacatggtgaaaccccgtctctactaaaaaatacaaaaactagctggaagtagtggcgtgcatctgtaatcccagctattcaggaggctgaggcaggagaattgcttgaagctgggaggtggaggttgcggtgagccaagatcatgccattgcactccagcctgggtgacagagggagactctgtcacaaaaataaaaataaaaaaaaaataaaataaaaagttacagtgtccttttaaattagatttgatgaaatggtgagcatctgcgttagaaacacaggataaaaagatttttttttttttttttggtaattgatctataccactgccacaaaactgaaaggtgaagtcatgacaagaaccactaaatgaaatgcatacacgtcattcaaaatgaaaactatcattagctaatggtcctaggacctgatctgtatacaaaggaatggaatcatatatgcaaaggtactaaaatgagactttaacaagtaagagattaaaatcttacaatctaatcactaggttttacagcttaaaaaaatactcttatcagtttttccactttaccctaggagtccttcttaactctgaaaatatactcctattctcaaattttgtctctgtttgtaccattgaaaggttacaatgtggtgttttcctcagaccaactgtttatatttacaaataaaagtctattttaaaaatgtttcagaccagtcagggagcagaactctggtaagaagagtattctacttgggaacaaggagggagttttaaggacatcatctactataattgctttgctctcccaggtagtaggaattacagaattttataaaaatcactggcatggtattacttattatttagtcttggtttcttaatatgtcaatttggccttcccataagagtagctacatgttaaaaaaaaggaaaagactaagatccagaagacgtcagaaagactgctggctttttaatatcttccaggtgctacaaaagccacatatagtcttgtatgttgacatgggccctgcaaggccagggcagaagagtatgactccaccatgtaaaggatgccaattggtggagccatggtagctggatttgggaggctgactagttcacaacctctgataaactgtcatccaagcctgaaccacggtcacataggagagccaggagtaaatgcattttaggtggcataactccttgtgttgcagcaaagaaagcaattatgaaaatggtcctgcattcattggaatgaaacctttgattctgaaggttactcatggactactgtgttaaatcttacttgataccatttaagtctgtataaaagtatgagtacatggtcagttttatcatgtaaaccaaatataatgcatttataaaattaaaactgaatttgcaaatttttgaacaacacacaatgatatgaaacaatgttcaccatatgaaattgaattacaaaagcaagaagtgaaataatatagagtgtaagatctcagttttgctaaaatggactttaaaatttactgtaaactaaatacacaaaaatagaaacctttctgtgctgataactgtttctgctgtgagaatagggaaaactttctctatttttcttatgtttctctgtctattgtcaatctaagctagttttaaaatgaacagaagttatttctataatcagaaaagaattaagtaaatgttgtttacaagatgaagtgaaaagaaaaaagttctgccatagcagcagacacaacccatttaaaagtgtttaatcattctaggtaattgtttaaagaaagttgcctataaataaacaagcctaccactaaatctactgaaattaggccctgtgttagagtaagcatatgaatgttgttggtaattacagtggcacaaaagcagtcctctggttttgtggtttatgattcataatcatttatttttttattcaatattaagaaatactctgaaagttactattgtcttaagaaaaagaaaatgtacttgtgtagtctttgaaaaaggcaatgtccaaagccatgtgactgcttctgttttatgagagaaacccacagtgtctcataggtctcttccagacacactggaatggtgccaatgtaagaatattaacaaagaacaagcactgagccaaataatttaattatcatttgttgacttcgtccatctaaactacatgaatctttatcccaatgacacaaaggcatcatttcactaaagctgatgaataactgcttacatattttcccactgaatacttaaattttgtcttgttcatttgcatggtttttatagttttggtttgttcttgctgttttgtatgttaaaggcattcaacttttgtctatcaaagttgtggcaaatattttcctagactgctgattaccattctgtttatggtattttttgtaaaatacagaagttagttttttagagggttatatctattggtgtttttctttgtgaattctgctgattgtattagttgattcaacaaatatttattacatactatgtgccagatactcctctatgtgatatgatacaacagtgatccaaaacaccgaatactcttgccctcatggagcttgcactcttacagaaggagacagacaattaacaattaaaatacatccaacttttgtagcacctgaatcctgaatcagttgtgggctgtctttaagaaaaagaatacaggaccttagaaagggaccatggaagtgaagggcttctgagcatatcgcatgggaatgagtgatatggagacaaataaagtggaggagaaagataggaagtgctaggtcagaagtagggatcacaaatttttcagagaagcctcactgagaatgtcaaatttgaacaaagaccaagaggagggacagaagcacacaaagaggatatctggggaaaagcatggtaggagaagaaaagagacagtgctaaatccctacagggagagaatgccaataatgttccaggaatgaaaaggaggtgggtagggctgaaacagagaaagccagagaaaaataatagaagatgagtcatagaggtaccaaatgaaattatgggagacggggagcagatgatgncntcgttgcaggcccagtcaattttcttggttttctctctctcagagtgagaggaggtcactagaggtgaaatgatttaacttatgctttcacttagattgataggttaagaataaacagtagggagaaagaatgcaaatagagagatggataaggaggatattgccataatccaggcgagagatcatggtggcttggatgagtctgcctggggaatgtgaggaaatataatttgtttttgaatatgtcttgaagatggaactatcaggattttctggtaaaatggatgtagattgtaaaaaaggagagtctatgggtgttgttctaagtaaatatggaactttaagtttattgaaatgagaaattcttttagagaataagcttttcggatacaagacaaatgagaagttccacttggagtatattaaatttgagatgtccattggatatacgaagtaagattgtcacacatgcagttggagctcagtagaaaagtccaggatgaatatatacctttaaacatcatcagcatatacttggaacttaaaagccataatatcagatatgagtcatataaatcactgtaacagttaacacgaggaataagcatagaaatgggaagaaacaatcagaagattgagtccttgaaggatgccaatgtttaggttagaaagatgtgggagaaccagcaagagagaatgtggtaggcagcaaaatggccttccaaagatgctcacatcccagcctttcaaaacctgttaatatattttggagagattgtcctggagtatccaggtggacccaatgtaatcagaatactgctcataagagggaggcaggaggatcagaaccaaagacagagatgtgatgacagaagcagaggtcagtgaggtaatatgattgctagaagggaggcacaagccaaggaattcaagtagcctctagaagctgcaaaagacaaggaaacaaattcccccctagcacctccagaaggtttgccaccgtgatattagctcagtgaaactccttttgcagttttgacctccagaactgtaagataaatttgtgttgctttaaaccactaagtttgttgtaatttgccaagagagggataggaagtaaatgcagagactgagaaaggagtagttagtgaagtaaacagatagataagagagtgtcatgtcacaggggccaaatgaggaagtgtttcaagaaggaagtagaataatggtcatttgataaactatgtcaaatgctgcttataggtcaagtaagataaagcctgagaaatgaacattgtttttagcaacatggaggtcacggatgaccttgacaggagaagatttggtagatggactatagagaaagccaaatcagaattggcttcgagagagtggagggtagccgggcatggtggtgcatgcctgtagtcccagctactcagggggctgaggtgggaggatggcttgaccccgggaggcagaggttacagtgtgccaagatcacaccactgcacttcagcctgggcgatagagccagaccttgtctgaaaaggtaaataaataaataaggtaaaataagggagagtggaaggaaggaactggagaaagaattgctgtggagtagtgactgctatgtgcttcctgtttttcccgtttttgaatgagagtctcttatctccataccatagattaaaaagaaacaactattaattcatacaatgacttggatggtgtattagtccattcttacattgctatgaagaaatacccgagactgggtaatttttgaaggaaagaggtttaattgactcacagttcctcagggctggggaggcctcaggaaacttacaatcatggtggaagagaaagcaaacatatccttcttcacatggtggcagcaacaagtgccgagcaaaaggggcttataaaaccattagatcttgtgagaactcaatcagtatcatgagaacagatgagggaaactgtccatgattcaattatctccacctggtctgtcccatgacacgtggggattatgggaacttcaaaatgagatttgggtgaggacacagccaggccatatcagatgttctcaaaggatttatactgactgaaaaaggccagtctcaaaaatcatatatcctccgtgattccacttatttaacattcaaaaaatggcaaaatgatagagacaaacaagaggtgaatgttttttagggattagggagggaagtagacaaggaaagggtgtgaacaatgaaaggagtccttgtgatggaactgttttgtattgactattgttatagttacacaaatttacatgtgataaagcttcatggacctaaatacatgcacacacacatacacacactacatgaatgcatgtaaaactagtgtaaatggaattaaggtcaacagtttatatcattgtcaatttctggttgtaatatttactttagttatgctatcactgggggaaactaagtgaaaattagtttcacgtgaatatacaattatctcaaaaagttaaaaagaatggtagaaatacacctaaagtaaattgactaaatttgcaagttaaatggcaagacttctcaaagtggattttaaaaaagtagtccatctatatatagtttacaacagacctacctaaaacataaagacacaaaattatgaatgtgaagaaatggaaaattatatttgaggtaaatataagcaaagaaagatgatgttacttcttataataatgtttaagaaatatattttgaagccaaagcattattgggaaaaaaggttacagaaaaataataaaaggagcaattcaccagtctgcatatacatttagtacatataaggactgtaaagaacaggtatacaggacattatgaacgtttttaatgccactggaccttatgcttaaaaatggttaagatggtaattttatgttatatgtatttttaccacaataaaaagagaaattgtaaggttgatagattagaaatctgtactcaagaattaaagcattttcattttttaaacatgtatgacactattaagaaataacatattttggcataaaatgagtcatacagatcatgcttctgctgataattcaaaaaaatttaaaaggaaaaaatatagcaaatatgatctccatgtatatggaaattttattttattttatttacttcaagcctttaatttgagacatgatggaaaaatcttgtaggcacacttggaaaagtcatgattaccgctgagtgaaaacaatctaactggaaagatttaatgcctgtcagctaatgtcaaagctgaaattctggaagtatgacatgctgcagggctgaaaggaatggaaaattagtgttccccttctttttcttcaacagaatccacaccaacctcctcataatctttttcaagggcagccatgtcctcacaggcctcagaaaatgcttcttctcccatctcctcacccatttcccagtgaacaaaggaacagttggcataactcaagtcagacttgtggcccaggcaaacccaggcctcagcaatggctatggtgttgctcagcatgcacgcagctctctttatgttggccagatttccagcaggtaccacagtgggaagctggcaattaatgccaactttgaggctagtgaaacaccaatccacaaactggatggtgcatttggtcttgttagtggaatagcagtaagtattgacatatttgggaaccacattaccacggtgtaataggcagtaagccatgtatttaccatagtgagagtcacatttcaccatctggttgcctggctcaaagtgagcactggtgacctctgctatgcatggtagtcttacccagcagagatgacagggcatatgtgaccaaagagaagaggatgcaggaagagggtaccaggtcggtctggaattctgtcagactccatgaaatctgagagaagcagtgatggagaacacaatctggctaagaaagcagttaaagattagggtagtttgggtgctcagtattggggtttctacaacagatgccatagatggcctcattgtctactatgaaggcacaatcaaagtgctgcaaggtggtactggtggtggaatggagttgtagagctcaaccgcagctgtggaaacctgcagggctaggtaaatggagaacttcagtttagactttgtggcataatcaacagagaagtgaacccagaaccagtttctccaccaaagctgtggaaaaccgagaagccctgaagacctgtgcactggtgaaccagcttgcgaatttggtccaaaggccaatgatcttgccaatgtcgtgatgcccccaggcatagttatgggcagcgtcttccttgtctgtgatgagctgctcagggtggaagagctggtggtaggtgccagtgcaaacttcatcagtgactatgggttccaggtttataaacactgccctggacacaaacttgcctgctcactgaagaggcgtagaatcaattatctccttacccagtggtcttgtcacttggcattgggctatcgtgctggatgctttgttccaggtagtagagctcccggcagcattgccaatccagacatcagcctcgccaaggtggatgaagatgcactcacacgtagtggctacaggttagaaaagcaaaagtcagaagatactgggtctctgttaccatccctgacatgttaagagtcaaataggcaacacattgtatttggaaattgttttttaaaaaaaaaggcataaatagctcatgaaacactttaagaagaaatgataatggaaattcgaaaatatttctatctgaatgataatgcaaatgctgtaaatcaaaatgtgtgggatttggctaaaaccacaattaaaaggcaaaagccttaattgcgtatattaggaaagaagaaaaactaaaaatcagcacaacttccagtttacacaggcagaaaaagaataatgaagtcatccaaagaaagtagaaagaaggaaaaacgtaaagatgagaatagaagatttttaaatggaaaataaccaatagctatcccatcaggggctggagggaagaggaaatggagacatcagttcaaggggtacatggtttatttacaaaagatgagtaacttctagaggactgctgtacaattgtacttaacaatactgcattgtccacttaaaaatttgtcatgagagtaaatcttaggctaagtgctcttatcacaataaaaaaatacagaaacagtagagtaaaaagtgctcaaagttaattcttttaaataaactaatacaatagacaaatcactggcagattaataagagagagaggctttaatgaaaactagaccacacaatcataaaataacattttgccaattattttgaaaatatattttttaagaaaaaaatacactttacagaatagattcaagaataaataaaagtctgagtaatcctattaaaataaatgaaattaaatcagtagtcaacaatttaagcattggtggaaaacacaacgacaaaaacgacaataacagcaaaaccaacaatgactgaaacaagaaaaaaacatgtattttaaatatatttacaagataatttcaataaacaagggtttgatagtatctattttattcacactgttctaaagtaaaagaaaaagtaagacagctcctcaacaattttatattttggtaaactatactttgataaaatctgtcagggatgttagtgaaaaaatttcagatcattatcttttataaaaattgatataaaaataatagcttaaatattaccaaatataacaaagaaaaacatgcacatttaaatcatgacaaagaatgatgaatttttttcttaagaatgcaagcataacaatgttaaaacgtgataaattaacatgtaatttatcactaagaaattaacaatttttaaaacatatgattatttcaatacatgcaggaaaatcattcaataaactcaggactcctttataatataaactcttaacaaataggagtaagggaccctatttaatatgaaaaaaagttagctaccaaatattactttaaccaagatactttgtaataaaatgttaaaaacatgcctttaaatcgagaacaaggcctcaatgccttcttctattcatcattgtgtggagttcctgctaaatggagaaggtatgcaaaataaatttgcaaggattagaaaaatataaaactgtcatcatttgcaaagattatgattatgtatatgaaagtccaagagaagttacagagaatggttatttaaaaattaaattcatatatacaaacagcaaacaaaaatataatttcaaaatatagcaattacagaagcaacgagagtactagaaatagaagtaacttcacagaggcaagactttaatgagaaagtcataaacctttattgaaagttataaaagacctaattaaatgtagagatacattacttacacataagacttactataacaaatatatgagttcttcctcctatttatctatactttcaaaaaaaaccccaagattttatcatttttatgaagcatgataaactcatcttaaaacttatgttagactataaagtgcctaaaacagttgagacttctcaaaaaacaaaaatgataatggtctagtcattcaaaatatattatgaaactatagtaaataaaaatttaactgaaaaaaagtaatagatagaaaaatccatttactgaacagatcgagccatgtatatgtgggtcctacccatgtatatgtgggttctacccacatatacatggcttgatctgttcagtaaatgattctgggtcaattggctaaacatacagaaataactaagatcaaatatatccttactttatataaaacacacatttttctaattgcattagaggcatgaaatgaaaagcaaaactagatgtttaggagaaaaaaagataatatttaaaaaattttgctgtgcctatatttcttaagcaaattaccctgaaaaggatgaaaaatcaatctggatatatagaagatatttgcagttcagaaaaccaaaactcattagtgtatggaatatgcaaataatttcttccaaacaagaaaaagagaagctagttattgaaaatgtttagcaaaagataattgatagaagaaagcataagctgcaaattaacattagaaagaatgttatattccattaaggatatacaaactaaaactgcaataaagtaacattttatatccatcagattggcaaaaataatgtctgataaatccaagtgttgggaaaccaggtctcctattatctgtggtagcataagttggtagagatatttgaacagaaatttggtagagtagtttggaagaacttgtcatacataataaaactagtagctgcatttccagaagtctttcataaactcctgcatatgtgcacaagaaaacatagaaaggtgtgctaatttcagcactgtttgtaaaagcaaacacatggaaatagcctaagagttgaaaacaacctaggtaagggaatggataacaaaccattgtttattcactagaaaaaatatcagacaaaagtgaaaaataaaagtgaatgaatcatgtctacctacatcaccaggtataattctcaaaaacatacaatgttgactaaagcaaaatgacactagaatacttaacatttgataccatttatgtaaaattttatacatgaaaataatattatatattgcagtggatatatttatgtttactaagagtacaaaaacaacataggtgaatggaaacacaaactaaagaatagtatttataaggtgtgagtgggaaagaagaggtaggagcaggaagggcttttgtcttagttgtagactttttgaaaaaatagagaaaattgagccaaatatagaaaaatattaatatctcctgggcatcaatggggcctatagttttcagttattcctttgtttgcaatattttattattaaaaattaaaacaagaatacatgaaatattgtgactgctttaacattcaggttctataggatcactgaaaactacatatgaaaaccaaattatttggtttcagtgaatgtgtgaaatgcatttggatttggtgtcattgatatactgcatttaggaagaaataaattcaatacacaggaaactgataaatgtatgattttatagaaataaatattaaaatgtttacttatgaaatcttgttctcctatttccttccctgctactcaaatagaaaaacatgtatctgaaatcacatattaagtctatgagaaaatgatatgaagcacagataccatctctgtgtaagttttcagtaatgctatacatgtaaaaagtaaatagttattcttgaaaataaagtcaatttaatatgcctgatcaatactgccctatgccatggtctaaaaatttttattatttaaaatgttacaaaggcatgatgaacaattataatcaatatttctcatattacattccatttgagtttagtaatatgagattagctttttcttcttgagtcattctgctttactatctcattttccttcagcagtaattattccaatttgtcatggtgttacagcaaaaatccaaaaaacataaaaaacttcttagctcatcttggtgccctaaattttcttggatttcaccaattttgtttattaggtcatacactgtctaattatatattagctgagtttatgatttaatattgatagtgagagtgaaaataatttggccattacattactctattaaaatggaaagctctataaacacagccagctctttttagctccatctagtctttgttgccattaatcagcattggagattgagagttttagatcattattctcaaaattgatacttgctcaatttcatagcttactttatgtgtcttgaaaacacataaagtagagatatctaaagaacaagaccatagggtacaggatttccatcaagcagagggcactaatttgcacatatttttattttgctaaatgattactaccaagtgcagattcacgctttgtactaaggtaatgtggagagctttcaggaagggctatcctgggtccagaagcttaatgtgtaggaaatccagtattacagattaaactagtcttgtaagtctttgttcatctttacggtctcaagaagagaactatgatcaaaagaaactgaagtggtagtcattttatttacatcacgttcatgtgcatatactctgtgctacaatcttcaaaattatgtttattgctcaaattcttccagaaaacccaaatctggtgtacattttatttccttcttagatgttttacctgttttgttggcatgcacaacttgaggtaagcctgtttcatcttatgagattgaaacaaaactctttttgagcataagtatagaattggacaattcagagcaattagtgctcttattgtctcagtgggctcctttgaaatgtttatagtaggctacattgtgaagatattgtgaaagtatttttatgtttcaagatagcaaacactttgaataaatcagtaaaaataaattttattggaaatttttgttttcacacacatttttgccttttctgttgataaccaaacattagagtattgctcatttttgcagaatttaaaggtgtctcaagcagcagactacaaggataaataaaaattaaaatgtattttcctagaacaccaggaaaacattttaaatttgaattcatttggaaatgtatttgtgttaaatgttttttgagtacctattcaaagaatgactaattaggtcccatttattaaacaataaatgactctcgtgttgctatcatggaagctacagtgtaatcaggttgaccaggaacatacataggaaaagttgaaaaataaggctaaatgacagcaagagtaatgaagattaccctccactaagaatattaatgccagaagataagaggccacacaatgggttggagtggtgagaaaatctatcagagtttgagctgtagaagtttaggatgtaagagaaattttaagatgaaacttttagaaaagcacattaaatgggctagggaaactgagaatagaaggaaggggaaaaattaataaagatttagctaagaagacaaggtcaaagaaagatgggggagaaaagaaattaggaggttgagttagacattagccttgggaaaaaagatgggcatgtattcacagagaaatatagaaaggaaaagacaagttaaagtttgaaatgtttggaacttaaacattttttaaaagactctatttgacatattgtttgcatcatatgaagttaaaggtattagactattttttaatttatacaccagcacattcatatggtttacaatactcaatcagcacttcctacttctagctttcatatcttgctttccttttctctaatatgtgaggtttttatcatagcctcacatattatatagttttttatttcctttcccagctagaaaattattttaggaagacaggaatttttctgatgttattgttattgaaaaaccattgcaactagaactagtacttaatattgttaagtgaataaataagtttgtttatactttttgtttttgctcttcattatttttccttgctttctaattaaagatgatttttggaattatcaaaaagtaagacatgcattcaatacagagtcaaggatgatcaaaagcagtgttgcttccaaacagggcccaactgaaaccaggtagcatgaatgtgcagtgggcaaggttgctgtatttctaggatgaatgctatgttagtccatttgcatttctttttgtaaaggaatagctgaggtttatttggctcacagttctgcaggctatactagcatggcaccagcatctgcttggcttcctggtgaggcctaggaaggttttactcatcacagaaggcaaagggggagcaagtgtgtcacatgacaagagagagcaagcaaggagttggacaggggagcaccacatgcttttaaagaaccagatgtcttgggaactcatcccactcattactgcagggatggcaccaagccattcatgagggatctgctaccatgccacagatgctttcttcccatcaggccccaccttcaacactggggatcacattttaacatgagatttggagggaacaaacatccaagctatatcatatgctcttttaaaaatactatattataaagtgctccttataaagttccagtggtggacaaaaaattgaactggacataattactagagaaaggaattgtttcgtgtaagaaacaggcagggcccaggtgaggttttccagcatagccatgaggctaatgaagatagtagccatcagttgacagctgatcctagtaaggaaaaaaacttcagtgggtctggggaagtgtgaaattatgtttgtaaaggggaagtatgaagtttaagatagaggggatggtgatcaaatggagtttgtgggttcaatcttcttcatatccagagaaatagtatgcatctcctttactctgaaagaacactgcctggccctatcaaagtaggcaacattcttgtccagtcaccaaataccctcttcttcctaccctggtttatgtgcaattctttttaaattctagtaacccctttcttactccattaagtgtccatatatattatctctttctctttctctctctctttcatgcaatacttcctggcatccatgttatcaccaattaaaagggtaaaaggaaagtttgcttttttatattataaggatttcaatctgacaaaaggtttaactcattactccatagttttccttgtggaaacatattgaagaagactcagtcaaaatatttgttggcataatgttcattttaggaaatcagagcatatctacttcctttaaatgtcctgaatctcccatcttatttgttggtatgtcatacaaacagtttctgtgatttactgtgaacttagtgaattgaataccttttaatatgatttttgtctattattaaacatgtgtaattaactttaaagaattttaatgttttatgagttgggagttcatttgacaaaaaaatgactggcatgtgtgaaacattgtgctaaataatcagaaaagtaacttttcatagagcatggttaattttaccttaacttagtagagatagttatatcatcttggcagtgttattcacaatctcaaacatcttccgagagaaagcagcagcattaattaaaaattccagagcaaaattaatgtcagacttcaaataaaaataattaattttcaaaatttaccctctgctggtatttcgaagtacaaaatttatttaccttatattattaaaataatgagatctagcatttataaaatattatacatttgccttcttcatccaaatgtttttacatatactccttaattttgccctcaccatcacctatttttgacaaactatttgactaagattttaaatataaaaagggcagtaagcacttaatatttatatcattttttaattcatcaaaaatgtaaattgtatcctcaccaggagagtgagtcactaatagacataagaatatgttgtatttataataaatcttacagggattgctttgtatgcatttagactgcaaatgggaactacaatcatgggaactgtgtgaatcattatgtttcacagtatgagatgccttgcctcaaccgttaagtgatgagagttttagattggacttattaaatgtgtaattatatacagagatagcaacatggactattgaggtttgagaagatttgtacatactttgaaccctagagcacatgacttctaagaaacaaatggaggcataattttcaaaataaatagccaattttaatttttttttttctgtgggggaaacaaaaattagtgaaagtttgctaaactgttataggttgtgagtttttatgataccatctgctgttgtagcataattagatattttaaaaataacatttaattttgtaacaagtaaccctttacatatgtgacttataaagttacacgtggtgtattcttttaagattttcattaatactaatggcttcctgtcccctaaaatgcaaatgataggtattaatagataggtaggtagggagagagagagagagagagagagagagactaagtctagcttataatttcagggggatcacagatctcttgagtctttaagtatccattgatctcggatgctctgccatgacagttgcttcatatatttgaatatgtcaataaactgcttatatcctgggtatagagaactcacctgaggatagttatgttattttgatataagacccctgcttgagctactcatttaaaattttataaaggaaataaattgcttaaattgaaatcctcaccagctcttatatttctatatagggtttaaactatttaggattataagaggaatgatatttaaaagttgacgtagccaggcatggtcgtcacgcctgtaattccagcactttgggaggctgaggtgggcggatcacaaggtcaggagttcgagaccagcctggccaacatggtgaaaccccgtctctactaataatacaaaaattagctgggcatggtggcacatgcctgtaatctcagctactctagaggctgaggcaggagaatcacttgaacctgggaggcggaggttgcagtgagccgagattgtgccactgcactctagcctaggcaacagagagagactctgtcaaaaaaaaaaaaaaacaaaaaaagttgacataattaggtatactgtattttactaggacaatttttactgatgttatagttgcctagtttaagttaataacctaattttgccctttcttttttgtcttaggccttgagcatctttccagattttttctgctgagctcaccattattttggctttgaaactcagtgtgatagaggtgatcgtgaggcatgccatgtgtagatgtctttcagctaataaatgaccatcctaaaattgagcttgtcaatagtggcttttcagatgagagcagggacagaacctcacctaggtatacacttggcttgatttaaattacaattgcacaaaaacagcaaagaagttagcagtagttttgccccttggttctcgagaccatgttcatctgattacaaaagacacagcaagtgctgctcaacctcctgctccctttctaggcttctagcccctcattttgcctcacaggagagctctactggacagacaattagcatgggattggaggccattctccagctttctgcatctgtcaaatgatggagagggtttgcctttttcagatctttgtgaaagggatcacccatttcttttaaacatctaatatatttcacacagaatggctataaaaagtaatcagttacatgtataacaccattgctttctcaacaatcagtgaagacagttgaatttacagccagaagacaatcacattatattggaccacatattcatacttcatttatttctccctcaagtattgcagctgtaatagctcctaggaagctttaaaaaatatgcaagaacattttaaacttccaggaacactcagacttcaaactactttttcttcttgtataacatctttaaataattaatttttttgtttcttttttagtgttctggtttgggaaatattaagataactggaaatgggaaaaaaaaggagaaggaatttgtgatttttcaatttccatgaaatcaacaaccttgcttcctagagtggattcttacagaggtcaatagtacacttgtgtgttgttgaaaattgttaacactcctatctaaaagccacaggatagtattccaaagactgtgaacaacaactccagggctcccagggatcctcagttgctgttaccaccagtggatttttttcaaaagcatttttaagaaatggtcataagcaggaatcaaatggtttggaatgaatctgttttgttggaagaaggggtttaattaactttcgagctgcacaaattaatctggactttagtgagggcctgaaaattgattaaaatgtgagcaccttttcagaaagtatttgaccaggaaataaattcatttcttcaaggtcagtgaccctacaagttgacaagtgattcagattaatacacacttgggtttcaagtttcacctattgcttggcagaagcttctgccccatcccccacccccagtgctgcttgtcatccacctgatctagttgtcaccttttcttctggactgtttttctgacagaaaccctttgcagagtttttggctggggggtggggaggtggttggggggcattgcaatcagtgcaacgtttcattttagttgttttattgaagatttaatcaacattatgatttaaaaataaggcagaaaataacttcacctagattaaacttacctcttaaagataataaatgtccatcaaacagaatgatttgtaaaatagtttcataaaatcctacttgatttaatgacctacctaatttttgcagtgtcttttattttttcttcttgggggctaaacacacataacacgcactcatgcacgtgcacacacacacaggcatatacatagacactccaagcatttggagactctcctctatattatctagtaatacaagctcagaggtcaagccttactgtaagagaatatggaaataattagagaaattttgtgtgagagtaaatgaagagactatttattctaagaagagaggaaattgtaaaaataaaaagtctcatcattgatttcaaaggagaacttgaaacaggattcaatcttgctaccctcatttaaaaaataagaaattgtggtcttagaaggttctgatctaccacattctttcatagttcacatgaagtggcaatgggatgatttaaggtgtttttatttccccttgatttaatgtcaagtataatttagtggacaattatatgtaacacctttgataattaattttccactccaaattaggctttggcaatcctcttatcctggtgtcattattcttatagaatactgtacacgttaactttgttttcttttctcattccctattaatgcttgttttttcaaataaatattaactattccacataacttctaagtaaagtttcagactttaataatacatttttttaattacagagtcagcatattctttgcaaaaaaaatccttagcaaatacctagagaaggtagagtttagcggagcaggaattttcttcatcttttaaattaaaaaattgaaccaactctccatgtacttcaacaactttttaccctcaaaagagaagagttttaacatcattaaatccgaacatatatttgaaaaaattagaaataatggccttatcagatagttacttatacttttttttaattttattattattatactttaagttttagggtacatgtgcaccacgtacaggtttgttacatatgtatacatgtgccatgttggtgtgctgcacccattaactcgtcgtttagcattaggtatatctcctaatgctatccctccctgctccccccaccccacaacagtccccggtgtgtgatgttccccttgttgtgttcatgtgttctcattgttcaattcccacctatgagtgagaacatgcggtgtttggttttttgtcctggcaatagtttgctgagaatgatggtttccagctcatccatgtccctacaaagggacataaactcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttataatcctttgggtatatacccagtaatgggatggctgggtcaaatggtctttctagttgtagatccctgaggaatcgccacaccgacttccacaatggttgaactagtttacagtcccaccaaccatgtgaaagtgttcctgtttctccacatcctctccagcacctgttgtttcctgactttttaatgatcaccattctaactggtgtgagatggtatctcattgtggttttgatttgcatttctctgatggccagtgatgatgagttttttcatgtgttttttggctgcataaatgtcttcttttgagaagtgtctgttcgtatactttgcccactttttgatggggttgtttggtttttttcttgtaaatttgtttgagttcattgtagattctggatattagccctttgtcagataagtaggttgcaaaaattgtctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctagattttcttctagggtttttatggttttaggtctaacctgtaagtctttaatccatcttgaattaatttttgtatactgtgtaaggaagggatccagtttcagctttctacatatggctagccagttttctcagcaccatttattaaataggggatcctttccccatttcttgtttttgtcaggtttgtcaaagatcttatagttgtagatatgcggcattatttctgagggctctgttctgttacattggtctgtatctgctttggtaccagtaccatgctgttttggttactgtagccttgtaatatagtttgaagtcaggtagcgtgatgcctccagctttgttcttttggcttaggattgacttggcgatgcaggctcttttttggttccatatgaactttaaagtagtttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggatttcactcatgatttggctctctgtttgtctgttattggtgtataagaatgcttgtgatttttgcacattgattttgtatcctgagactgctgaagttgcttatcagcttaaggagattttgggctgagatgatggggttttctagatacacagtcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcattgatagctcttattattttgagatacgtgccatcaatacctaatttgttgagagtttttagcatgaagtgctgttgaattttgtcaaaggccttttctgcatctattgagataatcatgtggtttttgtgtttggttctgtttatatgctggattatgtttattgatattcgtttgttgaaccagccttgcatcccagggatgaagcccacgtgatcatggtagataagctttttgatgtgctgctggattcgttttgccagtattttattgaggatttttgcatcgatgttcatcaaggatattggtctaaaattctctttttttgttgtgtttctgccagactttggtatcaggatgatgctggcctcataaaatgagttagggaggattccctctttttctattgattggaagagtttcaggaggaatggtaccagttcctccttgtacctctggtagaattcggctgtgaatccatctggtcctggactttttttggttggtaagctattaattattgcctcaacttcagagcttgttatttgtctattcagagattcaccttcttcctggtttagtcttgggagggtgtatgtgtacaggaatttatccatttcttctagattttctagtttatttgcatagaggtgtttgtagtattctctgatggtagtttgtatttctgtgggatcggtggtgatatcctctttatcattttttattgcgtctatttgattcttctctcttttctttattagtcttgctaacagtctatcaattttgttgatcttttcaaaaaaccagctcctggattcactgattttttgaacggtttttcatgtctctatttccttcagttctgctctgatcttagttacttcttgccttctgctaggttttgaatgtgtttgctcttgcttctgtagttcttttaattgtgatgttagggtgtcaattttggatctttcctgctttctcttgtgggcatttagtgctataaatttccctctacatactgctttgaatgtgtcccagagattctggtatgttgtgtctttgttctcgttggtttcaaagaacatctttattttagccttcatttcgttatgtacccagtagtcattcaggagcaggttgttcagtttccatgtagttgagtggttttgagtgagtttcttaatcctgagttctagtttgattgcactatggtctgacagacagtttgttataatttctgttcttttgcatttgctgaggagtgctttacttccaactatgtggtcaattttggaataggtgtggtgtggtgctgaaaaaaatgtatattctgttgattttgggtggagagttctgtagatgtctattgggtccacttggtgcagagctgagttcaattcctggatatcctcgttgactttctgtctcattgatctgtctaatgttgacagtggggtgttaaagtctcccactattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcttttttttgttttccatttgcttggtagatcttcctccatccctttattttgagcctatgtgtgtctctgcatgtgagatgggtttcctgaatacggcacactgatggatcttgactctttatccaatttaccagtctgtgtcttttaattggagcatttagcccatttacatttaaggttaatattgttatgtgtgaatttgatcctgtcattatgatgttagctagttattttgctcattagttgatgcagtttcttcctagcctcgatggtctttacaattggcatgtttttgcagtggctggtagcggttgttcctttccatgtttagtgcttccttcaggagctcttttagggcaggcctggtggtgacaaaatctctcagcatttgcttgtctgtaaagtattttatttgtccttcacttatgaagcttagtttggctggatatgaaattctgggttgaaaattcttttctttaagaatgttgaatattggcccccactctcttctggctggtagagtttctgctgagagatcagctgttagtctgatggacttccctttgtgggtaacctgacctttctctctggctgtccttaacattttttccttcatttcaactttggtgaatctgataattatgtgtcttggagttgctcttctcgaggattatctttgtggcattttctgtatttcctgaacttgagtgttggcctgctttgctcgattggggaagtgctcctggataatatcctgcagagtgttttccaacttgattccattctccccatcactttcaggtacaccaatcagatgtagatttggtcttttcacatagtcccatatttcttggaggctttgttcatttctttttattcttttttctctaaacttctcttcttgcttcatttcattcatttcttcttccatcgctgatatactttcttccagttgatcgcattggctactgaggcttgtgcattcatcacgtagttctcgtgccatggttttcagctccatcaggtcctttaaggacttctctgcattggttattctagttaccattcatctaattttttttcaaggtttttaacttctttgccattggttcagacttcctcctttagctcagagtagtttgatcttctgaagccttcttctctcatcaaagtctttctccatccagctttgttctgttgctggtgaggagctgtgttcctttggagggggagaggcgctctgattttttgagtttccagtttttctgctctgttttttccccatctttgtggttttatctacctttggtctttgatgatggtgacgtacagatgcgtttttggtgtggatgtcctttctgtttgttagttttccttctaacagtcaggaccctcagttgcaggtctgttggagtttgctggaggtccactccagaccctgtttgcctgggtatcagcagcagtggctccagaacagcagatattggtgaaccgcaaatgctgctgcctgatcgttcctctggaagttttgtctcagaagaatacctggtggtgtgaggtgtcagccgcccctacttgggggtggctcccagttaggctcctc

SEQ ID NO: 12652 - DNA, 5966 bp, Homo sapiens
gggctattttcttttctttttctttttttttttaattatactttaagttttagggtacatgtgcacaacgtgcaggtttgttacatacgtatacatgtgccatgttggtgtgctgcacccattaactcgtcatttacattaggtatatctgctaatgctatccctccccgctccccccaccccacaacaggccccagtgtgtgatgttcccgtttctgtgtccaagtgttctcattgttcaattcccacctatgagtgagaacatgcagtgtttggttttttgtccttgggatactttgctgagaacgatggtttccagcttcatccatgtccctacaaaggacataaactcatccttttatatggctgcatagtattccatggtgtatatgtgccacattttcttaatccagtctgtcattgatggacatttgggttggttccaagtctttgctattgtgagcactgctgtaataaacatacgtgtgcatgtgtctttatagcagaatgatttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtatgagatagtatggcattgtggttttgatttgcatttctctgatggccagtgatgatgagccttttttcatgtgtcttttggctgcataaatatcttcttttgagaagtgtcgttcatatcctttgcccactttttgatggggttgtttgattttttcttgtaaatttgtttgagttcattgtagattctggatattagccctttgtcagatgagtagattgcaaaaattttctcccattctgtaggttgcctgttcactctgatggtagtttctttggctgtgcagaagctctttagtttaattatatcccatttgtcaattttggcttttgttgccattgcttttggtgttttagacgtgaagtccttgtccatgcctatgtcctgaatggtattgcctaggttttcttctagggtttttatggttttaggtctaacatttaagtctttaatccatcttgaattaatttttgtataaggtgtaaggaaggggtccagtttcagctttctacatatggctagccagttttcccagcaccatttattaaatagggaatcctttccccattgcttgtttttgtcaggtttgtcaaagatcagatagttgtagatgtgtggcattatttctgagggctctgttctgttccattggtctgtatctctgttttggtaccagtaccatgctgctttggttactgtagtcttgtagtatagtttgaagtcaggtagcatgatgcctccagctttgttcttttggcttaggattgacttggtgatgcgggctcttttttggttccatatgaactttaaagtagcttttttccaattctgtgaagaaagtcattggtagcttgatggggatggcattgaatctataaattaccttgggcagtatggccattttcactatattgattcttcctacccatgagcatggaatgttcttccatttgtttgtatcctcttatttccttgagcagtggtttgtagttttccttgaagaggtccttcacatcccttgtaagttggattcccaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagatttggggctgagatgatggggtcttctagatacacaatcatgtcatctgcaaacagggacaatttgacttcctcttttcctacttgaataacctttatttccttctcttgcctgattgccctggccagaacttccaacactatgttgaataggagtagtgagagagggcatccctgtcttatgccagttttcaaagggaatgcttccagtttttgcccattcagtatgatattggctgtgggtttgtcataaatagctcccattattttgagatatgtcccatcagtaccaatttattgagagtttttagcatgaagggttgttggattttatcaaaggccttttctgcatctgttgagataatcatgtggtttttgtctttggttctgtttatatgctggattatgtttattgatttgcatatgttgaaccagccttgcatcccagggatgaagcccacttgatcatggtggataagctttttgatgtgtttgctggattcggtttgccagtattttattgatgatttttgcatcgatgttcatcagggatattggtctaaaattctctttttctgttgtgtctctgccaggctttggtatcaggatgatgctggcctcataaaatgagttagagaagattccctctttttctattgattggaatagtttcagaaggaatggtaccagctcctccttgtacctctggtagaatttggctgtgaatctgtctggtcctggactttttttggttggtaagctattaattattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagtggtctgtcaatgttgttgatcttttaaaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtggtgttagggtgtcaattttagatctttcctgctttctcttgtgggcatttagtgctataaatttccctctacacactgctttaaatgtctcccagagattctggtatgttgtatctttgttctcattggtttcaaagaacttctttatttctgccttcatttcgttatgtacccagtagtcattcaggagcaggttgttcagtttccatgtagttgagcggttttgagtgagtttcttaatcttgagttctagtttgatcgcactgtggtctgagagacagtttgttatcatttctgttcttttacatttgctgaggagtgctttacttccaactatgtggtcaattttggaacaagtgcggtgtggtgctgagaagaatgtatattttgttgaattggggtggagagttctgtagatgtctattagctccacttggtgcagggctgagttcaattcctagatatctttgttaactttctgtcttgtggatctgtctaatgttgacagtgggtgttaaagtctcccattattattgtgtgggagtctaagcctcttcgtaggcctctaaggacttcctttatgaatccgggtgctcctgtactgggtgcatatatatttaggttagttagctcttcttgttgaattgatccctttaccattatgtaatggccttctttgtctcttttgatctttgttggtttaaagtctgttttatcagagactagggttgcaacccctgccttgttttgttttccatttgcttggtagatcttcctccatccctttattttgagcctgtgtgtctctgcacgtgagaagggtttcctgaatacagcacactgatgggtcttgactctttatccaacttgccagtctgtgtcttttaattggagtatttagcccatttacatttaaggtttatattgttatgtgtgaatttgatcctgtcattgagatgttagctggttattttgctcgttagttgatgcagtttcttcctaaccttgatggtctttacgatttggcatgtttttgcagtggctggtaccagttgttcctttccatgtttagtgcttccttcaggagctcttgtagggcaggcctggtggtgacaaaatctctcagcatttgcttgtctgtaaaggattttatttctccttcacttatgaggcttagtttggctggatatgaaattctgtgttgaaaattcttttctttaagaatgttgaatattggcccccactctcttctggcttgtagaatttctgccgagcgatcagctattagtctgatgggcttccctttgtgggtaacccgacctttgtctctggctgcccttaacattttttccttcatttccactttggtgaatctgacaattaagtgtcttggagttgtccttctcaaggagtatctttgtggacttctctgtatttcctgaatttgaatgttagcctgccttgctggattggggaagttctcctgcataatttcctgcagagtgttttccaacttggttccattctccccgtcactttcaggtacaccaatcagatgtagatttggtcttttcacatagtcccatatttcttggagggtttgtttgtttctttttattcttttttctctaaacttctcttctcacttcatttcattcatttgatcttccatcaagataccctttcttccagttgatcgaattggttagtgaggcttgtgcattcatcatgtagttctcgtgccgtggttttcagctccatcaggtcctttaaggacttctgtgtattagttattctagttagccatttgtctaatcttttttcaaggtttttgacttctttgccatgggttcgaacttcctcctttagctcggagaagtttgatcgtctgaagccttcttctctcaactcatcaaagtcattctccatccagctttgttccgctgctggtgaggagctgcgttcctttggagaagaagaggttctctgatttttagaattttcagtttttctgttctgttttttccccatctttgtggttttatctacctttggtctttgatgatggtgacatgcagatggggttttggtgtggatgttctttctgtttgttagttttccttctaacagtcaggaccctcagctgcaggtctgtcggagtttgccagagctcaactccagaccctgtttgcctgggtatcagcagcggaggctgcagaacagcgaatattggtgaacagcaaatgctgctgtctgatcgttcctctggaaattttgtctcagaggggtacctggccgtgtgaggtgtcagtctgcccctactggggggtgcctcccagttaggctactcgggggtcagggacccacttgaggaggcagtctgtccgttctcggatctcaagctgcatgctgggagaaccactgctgtcttccaatctgtcagacagggacatttaagtctgcagaggtttctgctgccttttgtttggctatgccctgctgccagaggtggagtctacaagaggcaggcaggcctccttgagctgtggtgggctccacccagttcgagcttcctggctgctttgtttacctactgaagtctcagcaatggcgggcgcccctcccccagccttgctgccgccttgcagtttgatctcagactgctgtgctagcaatgagcgaggctccgtgggcgtaggaccctctgagccatgcgcgggatataatctcctggtgtgccgtttgctaagaccatcggaaaagtgtagtattagggtgggaatgacccaatttttcagatgctgtctgtcacccctttccttggctagaaaagggaattccctgaccccttgtgct

SEQ ID NO: 12653 - DNA, 6048 bp, Homo sapiens
tttttttttctttaatttatttatttattattattatactttaagttttagggtacatgtgcacaatgtgcaggttagttacatatgtatacatgtgacatgctggtgggctgcacccactaactcgtcatctagcattaggtatatctcccaatgctatccctcccccctccccccaccccacaacaggctccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaaagggatggctgggtcaaatggtatttctagttctagatccctgtggaatcgccacactgacttccacaatggttgaactagtttacagtcccaccaacagtgtaaaagtgttcctatttttccacatcctctccagcacctgttgtttcctgactttttaatgattgccattctaactcgtgtgagatggtatctcattgtggttttgatttgcatttctctgatggccagtgatggtgagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacgagtaggttgcgaaaattttctcccattttgtaggttgcctgttcactctgacggtagtttcttttgctgtgtagaagctctttagtttaattagatcccatttgtcaattttggcttttgttgccattgcttttggtgttttagacatgaagtccttgcccatgcctatgtcctgaatggtaatgtctaggttttcttctagggtttttatggttttaggtctaacttttaagtctttaatccatcttgaattgatttttgtataaggtgtaaggaagggatccagtttcagctttctacatatggctagccagttttcccagcaccatttattaaatagggaatcctttccgcattgcttgtttgtctcaggtttgtcaaagatcagatagttgtagatatgcggcattatttctgagggctctgttctgttccattgatctatatctctgtgttggtaccagtaccatgctgttttggttactgtagctttgtagtatagtttgaagtcaggtagtgtgatgcctccagctttgttcttttggctcaggattgacgtggcaatgcgggctcttttttggttccatatgaactgtaaagtagttttttccaattctgtgaagaaagtcattggtagcttgatggcgatggcattgaatctgtaaattatcttgggcagtatggccatttttcacgatattgattcttcctacccatgagcatggaatgttcttccatttgtttgtaccctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttattttcttctcctgcctgatcgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaagaacttttctgcatctattgagataatcacgtggtttttgtctttggttctgtttatatgctggattatatttattgatttgcgtatattgaaccagccttgcatcccagggatgaagcccccttgatcatggtggataagctttttgatgtgctgctagattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttagttggtaagcttttgattattgccacaatttcagatcctgttattggtccattcagagattcaacttcttcctggtttagtcttgggagagtgtatgtgtccagaaacttatccatttcttctagattttctagtttatttgcgtagaggtgtttgtagtattctctgatggtagtttgtatttctgtgggatcggtggtgatatccccattatcattttttattgcgtctatttgattcttctctctttttttctttattagtcttgctagcggtctatgaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcattatgtacccagtagtcattcaggagcaggttgttcagtttccatgtagttgagtggttttgagtgagattcttaatcctgagttctcgtttgattgcactgtggtctgagagatagtttgttataatttctgttcttttacatttgctgaggagtgctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgctgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggactgcaacccctgcctttttttgttttccatttgcttggcagatcttcctccatccttttattttgagcctatgtgtgtctctgcatgtgagatgggtttcctgaatacagcacactggtgggtcttgactctatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgttgagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggccctcattctcttctggcttgtagagtttctgccgagagatctgctgttagtctgatgggcttctctttgagggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctatattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcacttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaggttttcaacttctttgcctttggttgaatgtcctcccgtagctcggagtaatttgatcatctgaagccttcttctctcagcttgtcaaagtcattctccatccagctttgttccgttgctggcgaggaactgcgttcctttggaggaggagagtcgctctgctttttagagtttccagtttttctgctctgttttttccccatctttgtggttttttctacttttggtctttgatgatggtgatgtacagatgggtttttggtgtggatgtcctttctgtttgttagttttccttctaacagacaggaccctcagctgcaggtctgttggagtacccggccgtgtgaggtgtcagtctgcccctgctggggggtgcctcccagttaggctgctcggggggtcaggagtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagactccgtgggcgtaggaccctccgagccaggtgcaggatataatctgatgcgccattttttaagccggttggaaaagcgcagtattcgggtggaagtgacccgattttccaggtgccgtgtgtcacccctttctttgactaggaaagggaactccctgaccccttgcgcttcccgagtgaggcaatgcctcgccctgcttcggcttgcacacggtgcacgcacccactgacctgcgcccactgtctggcactccttagtgagatgaacccggtacctcagatggaaatgcagaaatcacccgtcttctgctcgctcacgctgggagctgtagactggagctgttcctattcggccatcttggcgcctccccct

SEQ ID NO: 12654 - DNA, 4949 bp, Homo sapiens
tttttttaaattaattaatttatttatttatgaattatacttttgagttctagggtacatgtgcacaacgtgcaggtttgttacatatgtatacatgtgccatgttggtttgctgcacccatcaattcattatttacattagatatttctcctaatgctatccctcccccagccctccaccccctgacaggccccggtgtgtgatgttccccaccctgtgtccaagtgttctcattgttcagttcccacctatgagtgagaacatgcagtgtttggttttctgtccttgtgatagtttgcttagaatgatggtttccagcttcatccacgtccctgcaaaggacatgaactcatccttttttatggctacatagtattccatggtatatatgtgccacaatttcttaatccagtctatcattgatggacatttgggttggttccaagtctttggtactgtgaatagtgccgcaacaaacatatgtgtgcatgagtctttatagtagcatgatttataatcctttgggtatatacccagtaatgggatggctgggtcaaatggtatttctagttctggatccttgaggaaccaccacactgtcttccacaatcattgaactaatttacactcccaccaacagtgtaaaagtgttcctatttctctacatcctctccagcatctgttgtttcctgactttttaatgatcaccgttctaactggtgtgagatggtatctcattgtggttttgatctggatttctctgatgaccagtgatgatgagcattttttcatgtttctgttggctgcataaatgtcttcttttaagaagtgtctgttcatatcctttgcccacttttaggtggggtggttggtcttttccttgtacctttgtttagattctttgtagattctggatattaaccctttgtcagatgggtagatggcaaaaattttctcccattctgtaggttgcttgttcactctgatggtagtttattttgccatgcagaagctctttatttaattagataccatttgtctattttggcttttgttgccattgcttttggtgttttagtcatgaagtccttgcccaggcctatgtcctgaatggtattgcctaggttttcttctaggggttttatggttttaggtctaacatttaagtctttaatccgtcttgaattaatttttatataatgtgtaaggaagggatccagtttcagttttctacatatggctagccagttttcccagcaccatttattaaacagggaatcctttcccgatttcttgtttttgtcaggtttgtcaaagatcagatggttgtagatgtgtggtgttatttctgaggcctctgttctgttacattggtttatatatctgttttgataccagtactatgctgttttggttactgtagccttgtaatatagtttgaagtcaggtagcgtggtgtctccagctttgtttttttttgcttaggattgtcttggcaatgtgggctcttttttggttccatatggactttaaagtagttttttccaattctgtgacgaaagtcattggtagcttgatggggatggcattgaatctgtaaattaccttgggcagtatggccattttcatgatattgattcttcctatccatgagcatagaatgttcttccattttgtttgtgtcctcttttatttcactgagcagtggtttgtagttctccttgaagaggtccttcacatcccttgtaagttggattcctaggtattttattctctttgtagcaattgtggatgggagttcactcatgatttggctctctgtttgtctgttatttgtgtataggaatgcttgtgatttttgcagattgattttgtatcctgagactttgctgaagttgcttatcagcttaaggagattttgggctgagataatggggttttctaaatatacgatcatgtcatctgcaaaccgggacaatttgatttcctcttttcctaattgaataccctttatttctttctcttgcctgaatgccctggccagaacttccaacactatgttgaataggagtggtgagagaggacatcattttcttgtgtgagttttcaaagggaatgctcccagtttttgcccattcagtatgatactggctgtgggtttgtcataaatagctcttattattttgagatacgttccttcaacacctagtttattgagagtttttagcatgaagagctgttgaattttgttgaaggacttttctgcatccattgagataatcatgtgttttttgtcgttggttctgtttatgtgatggattacgtttattgatttgcatatgttgaaccagccttgcatcccagggatgaagcccacttgatcgtggtggataagctttttgatgtgctgctggattcgatttgccagtattttattgaggacttttgcatcgatgtttatcagggatattggtctaaaattctctttttggttgtgtctctgccaggctttagtatcaggatgattctggcctcataaaatgagttaaggaggagtccctctttttctattgattggaatagtttcagaaggaatggtaccagctcctctttgtacctctggtagaatttggctgtgaatccgtttggtcctggactttttttggttggtaggctattaattattgcctcaatatcagaacctgttattggtctattcagagattcaacttcttcctggtttagtcttgggagggtgtatgcgtccaggaatttattcatttctactaggttttctagtttatttgcgtagaggtgtttatagtattctctgatgatagtttgtatttctgtgggattggtggtgatatcccctttatcattttttattgcatctatttgattcttctctcttttttttctttattggttttgctagcggtctatcaattttgttgatcgtttcaaaaaaccagctcctggatttgttgattttttgaagggttttttgtgtctctatctccttcagttctgctttgatcttagttatttcttgccttctgctagcttttgaatgtatttgctcttgcttctctagttctttgaattgtgatgttagggtgtcaattttagatctttcctgctttctcttgtgggcatttagtgctataaatttccctctatacactgctttaaatgtgtcccagagattctggtatgttgtgtctttgttctcattggtttcaaagaacatctttatttctgctttcatttcgttatttacccagtagtcattcaggagcaggttgttcagtttccatgtagttgtgcagttttgagtgagtttcttaatcctgagttctaatttgattgcactgtggtctgagagacagtttgttgtgatttctgttcttttacatttgctgaggagtgctttacttccaactatgtggtcaattttagaataagtgcgatgtggtgctgagaagaatgtatattctgttgatttagggtggagagttctgtagatgtctgttaggtcttcttggtgcagagctgagttcaagtcctggatatccttgttaaacttctgtcttgttgatctgtctaatattgacagtggggtgtgaaaatctcccattattattgtgtgggagtctaagtctctttgtaggtatctaaggacttgctttatgaatctgggtgctcttgtattgggtgcatatctatttaggatagttagctcttctcgttgaattgatccctttaccattatgaaatgaccttcgttgtctcttttgatctttgttggcttaaagtctgttttatcagagcctaggattgcaacccctgctttattttgctttccatttgcttggtagatcttcctccatccctttattttgagcctatgtatgtctctgcacatgagatgggtctcctgaatacagcacactgatgggtcttgactctttatccaaattgccagtctatatcttttaattggagcatttagtccatttacacttaaggttaatattgttatgtgtgaatttgatcccgtcattatgatgttaggtggttattttgcccgttaattgatgcagtttcttcatagcatcgatggtttttacaatttggcatgtttttgcagtggctggtaccggttgttcctttccatgttcaatgcttccttcaggagctcttgtaaggcaggcctgctggtgacaaagtctctcagcatttgcttgtctgtaaaagattttatttctccttcagttatgaagcttagtttggctggatatgaaattctgggttgaaaattcttttctttaagaatgttgaatattggcccccactctcttctggcttgtagggtttctgctgagagatccgctgttagttgatgggcttccctttgtgggtaacccgacctttctctctggctgcccttaaccttttttccttcatttcaactttggtgaatctgacaattatgtgtcttggggttgctcttctcaaggagtatctttttggtgttctctgtatttcctgaatttgaagtttggcctgccttgctaggttggggaagttctcctggataatatcctgaagactgtttcccatcttggttccattctccccctcactttcaggtacaccaatcgaatgtagatttggtcttttcacatagtcccatatttcttggaggctttgttcacttctttttactcttttttctctaaacttgtcttcttgctttatttcattaatttgatcttcaatcactgataccttttcttccacttgatcgaatcggctattgaagcttgtgcatgcatcacgaagttcttgtaccatagttttcagctccatcaggtcatttaaggtcttctctacactgtttattctagtttagccattcctgtaaccttttttcaaggttttt

SEQ ID NO: 12655 - DNA, 6628 bp, Homo sapiens
atatatcttttttttaattttattattattatactttaagttttagggtacatgtgcacaacgtgcaggtttgttacatatgtatacatgtgccatgttggtgtgctgcaccaattaactcgtcatttagcattaggtatatctcctaatgctatccctcccccctcccccaactccacaacagtccccggtgtgtgatgttccccttcctgtgtccatgtgttctcattgttcaattcccacctatgagtgagaacatgcggtgtttggttttttctccttgcgatagtttgctgagatattgactaaattcaaaaagatgttaaatggatttttctgtaaattaaacgttgaaataaaaacacaacaaaatactcttaaaacactaatctactctttaactaaatttgtaaaaaattataaaaggtttgtaaaaatctcaccttatagtcaaactggttaagattaaataaagttatccataaaagttcattaaaaattgggattaacattaataatagactagtacaaagataaaattaaaattaactttctctcttaaacagaattttcacgtaataattaagactaataaaagatatttgctttttcaaatatttgagtcattttaacaaaataagtaacttataataatctaaaagtctattttataatatcaaatgttttaaaactctaacatattcaacaaacgtcccaaaattaaacttcagtttcaagattatctttcctaacccctaacttttagggcacctagaacatcaaaagaaagataaacaagatatttaatatatttaaataggtgggattgcaaaaatgatatttaatcttcttcagattatatttcgataaataacattaatatatgttccaaaattgtataaaatgtctaagattctagtgtatacatatatgctatcaattataattaaggttattatattacaatattataaaatcagaaataaccaaatttctttgtccaaaatcgtgtgatatgtctaggattctagtgtctttttttttattatactttaagttttagggtacatgtgcacaatgtgcaggttaattacatatgtatacatgtgccctgctggtgtgctgcacccattaactcatcatttagcattaggtatatctcctaatgctatccctccccgctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatctccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgaatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtgtctcattgtggtcttgatttgcatttctctgatggccagtgatggtgagcattttttcatgtgttttttggctgcataaatgtcttcttttgagaagtgtctgttcacctcctttgcccactttttgatggagttctttgtttatttcttgtaaatttgtttgagttcattgtagattctggatattagccctttgtcagatgagtaggttgcaaaaattttctcccattttgtaggttgcctattcgctctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttatccatcttgaattaatttttgtataaggtgtaaggaagggatccagtttcagctttctacatatggctagccagttttcccagcaccatttattaaatagggaatcccttccccagtgcttgtttttctcaggtttgtcaaagatcagatagttgtagatatgtggcgttatttctgagggctctgctctgttccattgatctatatctctgttttggtaccagtaccatgctgatttggttactgtagccttgtagcatagtttgaagtcaggtagcgtgatgtctccagctttgttcttttggcttaggattgacttggcgatgcgggctcttttttggttccatatgaactttaaagtagttttttccaattctgtgaagaaggtcattggtagcttgatggggatggcattgaatctataaattaccttgggcagtatggccattttcatgatactgattcttcctacctatgagcatggaatgttcttccatttgtttgtatcctcttttatttcgttgagcagtggtttgtagttccccttgaagaggtccttcacatcccttgtaagttggattcttaggtattttattctctttgaagcaattgtgaatgggagttcactcatgatttggctctctgtttgtctgatattggtgtataagaatgcttgtgatttttgtacattgattttgtatcctgagactttgctaaagttgcttatcagcttaaggagatttggggctgagacaatggggttttctagatatacaatcatgtcatctgcaaagagggacaatttgacttcctcttttcctaattgaataccctttatttccttcttctgcctaattgccctggccagaacttccaacactatgttgaataggagtggtgagagagggcatccctgtcttgtgccagttttcaaagggaatgcttccagtttttgcccattcagtatgatattggctgtgggtttgtcatagataactcttattattttgagatacgtgccatcagtacctaatttcttgcgagtttttagcatgaagcattgttgaattttgtcaaaggccttttctgcatctattgagatactcatgtgatttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcttcaatgttcatcaaggatattggtctaaaattctcttttatggttgtgtctctgcctggctttggtatcaggatgatgctggcctcataaaatgagttagggaggattccctctttttctattgattggaatagtttcagaaggaattgtaccaggtcctccttgtacctctggtagaattcggctatgaatccatctggtcctggactctttttggttggtaagctattgattattgccacaatttcagctcctgttattggtctattcagagattcaacttcttcctggtttagtcttgggagggtgtatgtgtcgaggaatttatccatttcttccagattttctagtttatttgcgtagagatgtttgtagtattctctgatggtagtttgtatttctgtgggattggtggtgatatcccctttatcattttttattgcatctatttgattcttctctcttttcttctttattagtcttgctagtggtctatcaattttgttgatcctttcaaaaaaccagctactggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacttctttatttctgccttcatttcgttatgtacccagtagtcattcaggagcaggttgttcagtttccatgtagttgagcggttttgggtgagtttcttaatcctgagttctagtttgattgcactgtggtctgagagacagtttttataatttctgttcttttacatttgctgaggaaagctttacttccaactatgtggtcaattttggaataggtgtagtgtggtgctgaaaaaaatgtatattctgttgatttggggtggagagttctgtagatgtctattaggtctgcttggtgcagagctgagttcaattcctgggtatccttgttaactttctgtctcgctgatctgtctaatattgacagtggggtgttaaagtctcccattattattgtgtgggagtctaagtctctttgtaggtcattcaggacttgctttatgaatctgggtgctcctgtattgggtgcatatatatttaggatagttagctcttcttgttgaattgatccctttaccattatgtaatggccttctttgtctcttttgacctttgttggtttaaagtctgttttatcagagactaggattgcaacccctgcctttttttgttttccatttgcttggtagatcttcctccatctttttattttgagcctgtgtgtgtctctgcacgtgagatgggtttcctgaatacagcacactgatggaccttgactctatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacaatttggcatgattttgcagtgtctggtactggttgttcctttccatgtttagtgcttgccttcaggacctcttttagggcaggcctggtgctgacaaaatgctctcagcatttgcttgtctgtaaagtattttatgttctccttcacttatgaagcttagtttgtctggatatgaaattctgggttgaaaattcttttctttaagaatgttgaatattcacccccgactctcttctggcttgtagggtttctgccgagagatccgctgttagtctgatgggcttccctttgtgggtaacccgacctttctctctggctgcccttaacattttttccttcatttccactttggtgaatctgacaattatgtgtcttggagttgttcttctcgaggagtatctttgtggcgttctctgtatttcctgaatctgaatgttggcctgccttgctagattggggaagttctcctggataatatcctgcagagtgttttccaacttggttccattctccccgtcactttcaagtacaccaatcagacatagatttggtctttttacatagtcccatatttcttggaggctttgttcgtttctttttattcttttttctctaaacttcccttctcgcttcatttcattcatttcatcttccatcgctgataccctttcttccagttgatcgcatcagctcctgaggcttctgcattcttcatgtagttctcgagacttggctttcagctccatcagctcctttaagtacttctctgtattggttattctaattatacatttgtctaaatttttttcaaagtttttaacttctttgtctttggtttgaatttcctcctgtagctcggagtagtttgatcgtctgaagacttattctctcaacttgtcaaagtcatcctccgtccagctttgttccgttgctggtgaggaactgcattcctttggaggaggagaggcgctctgctttttagagtttccagtttttctgctctgttttttccccatctttgtggttttacctacttttggtctttgatgatggtgatgtatagatgggttttcggtgtggatgtcctttctgtttgttagttttccttctaacagacaggaccctcagctgcaggtctgttggagtttgctagaggtccactccagaccctgtttgcctgggtatcagcagcggtgtctgcggaaccgcggattttcatgaactgcgaatgctgctgtctgatcattcctctggaagttttgtctcagaggagtacccggccgtgtgaggtgtcagtctgcccctactggggggtgcctcccagttaggctgctcgggggtcaggggtcagggacccacttgaggcagtctgcccattctcagatctccagtgcatgctgggagaaccactgctctcttcaaagctgtcagacagggacatttaagtctgcagaggttactgctgtctttttgtttgtgccctgccc

SEQ ID NO: 12656 - DNA, 4830 bp, Homo sapiens
ttttttttttttaaattatactttaagttctggggtacatgtgcacaacgtgcaggtttgttacataggtatacatgtgccatgttgctttgctgcacccatcaacttgtcgtttacattaggtatttctcccaatgctatccctcccccagccccccacccctgacaggccccaatgtgtgatgttcccctccctgagtccatgtgttctcattgttcaactccctcttatgagtgagaacatgtggtgtttggttttctgtcctgtgataattcgctgagaatggtggtttccagcttcatccatgtccctgcaaaggacatgaactcatcctttttttaggctgcatagtattccatggtgtatatgtgccacattttcttaatccagtctattattgatggacatttgggttggttccaagtctttgctattgtgaatagtgccgcagtaaacatacgtgtgcatgtgtctttatagcagcatgatttataatcctttggatatatacccagtaatgggattgctgggtcaaatggcatttctagttctagatccttgaggaatgaccacactgtcttccacaatggttgaactaatttacactcccaccaatgtgtaaaagtgttcctatttctccacatcctctccagcacctgttgtttcctgactttttaatgatctccattctaactggcatgagatgatatctcactgtggttttgatttgcatttctctaatgaccagtgatgatgagcattttttcatatgtctgttggctgcacaaatgtcttcttttgagaagtgtctgttcctatcttttgcccactttttgatggggttgtttgatcttttcttgtaaatttgtttaagttctttgtagattctggatattagccctttgtcagatgggtagattgcaaaaattttatcccattctgtaggttgtctgttcactctgctgatagttttttttttgctgtgcaaaagctctttagtttaattagatcccatttgtctcttttggcttttgttgccattgcttttagtgttttagtcatgaagtctttgcccatgcctatgtcctgaatggtattgcctaggttttcttctagggtttttatgattttgggtcttatatttaagtctttaatacatcttgaattaatttttgtataaggtgtaaggaagggatccactttcagctttctacatgtggctagccagttttcccagcactgtttataaaatagggaatcctttccccattgcttgtttttgtcaggtttgtcaaagatcagatgattttagatgtgtggtgttatttctgaggcctttgttctgttccattggcctatatctctgttttggtaccagtaccatgctgttttggttactgtagacttgtagtatagtttgaagtcaggtagtgtgatgcctccagctttgttcttttggtttaggattgtcttggctatgcaggctcttttttggttccatataaactttaaagtagttttttccagttctgtgaagaaagtcagtggtagcttgatggggatagctttgaatctataaactactttgggtagtatggcattttcacaatattgattcttcctatccatgagcatggaatgttcttccatttgtttgtgtcctcttttacttcattgagtagtggtttgtagttctccttgaagaggtccttcacatcccttgtaagttggattcctaggtattttattctctttgtagcaattgtgaatggagttcactcatgatttggctctctgtttgtctgttattggtgtatagggatgcttgtgatttttgcacattgattttgtatcctgagactttgctgaagttgcttatcagcttaaggagattttgggctgggacgatggggttttctaaatatacaatcatgtcatctgcaaatagggacaatttgacttcctcttttcctaattgaatatgctttatttctttctcttgcctgattgccctggccagaacttccaatactatgttgaataggagtggtgagagagggcatccttgtcttgtgccagttttcaaagggaatgcgtccagtttttgcccattcagtatgacattggctgtgggtttgtcataaatagctcttattattttgagatacattccatcaatacttagtttattgagagtttttagcatgaagcgctgctgaattttgtcgaaggccttttctgcatctattgagagagtcatgtggtttttgtctttgattctgtttatgtgatggattacgtttattgatttgcatatgttgaaccagccttgcatcccagggatgaagccgacttgattgtggtggataagctttttgatgtgctgctggattcggtttgccagtattttattgaggattttcacatcgatgttcattagggatattggcctaaaattctctttttttgttgtgtctctgccaggatttggtatcaggatgatgctggcctcataaaatgagttagagaggattccctctttttctgttgattggaatagtttcagaaggaatggtatcagctactctttgtacctctggtagaatttggctgtgaatctttctggtcctggactttttttggttggtaggctattaattattgccttaatttcagaacctgttattggtgtattcagagatttgacttcttcctagtttagtcttgggagggtgtatgtgtccaggaatttatccatttcttctagattttctagtttatttgcatagaggtgtttatagtattctctgatggtagtttgtatttctgtgggatcagtagtgatatcccctttatcattgtttattgcatctattggattcttctctcttttcttctttattagtcttgctagcggtctatgaattttgttgatcttttcagaaaaccagctcctggattcattgatttttgaaggtttttttgtgtctctatctccttcagttcttctctgatcttaattatttcttgccttctgctagcttttgaatgtgtttgctcttgcttctctagttcttttaattgtgatgttagggtgtcaattttagatctttcctgctttctcttgtgggcatttagtgcaataaatttccctctacaccctgctttaaatgtgtcccagagattctggtatgttgtgtctttgttctcattggtttcaaagaacatctttatttctgccttcattttgttatgtacctagtagtcattcaggagcaggttgtacagtttgcatgtagttgagcagttttgtgtgagtttcctaatcctgagttctagtttgattgcactgtggtctgagagacagtttgttataatttctgttcttttacatttgctgaggagtgctttacttccaactgtgtggtcagttttggaacagtgcgatgtggtgctgagaagaatgtatattctgttgatttggggtggagagttctgtagatgtctattaggtctgcttggtgtagagctgagttcagttcctggatatccttgttaactttctgtctcgttgatctgtctaatgttgacagtggggtgttaaaagtctcccgttattattgtgtgggagtcttaagtctctttgtaggtctctaaggacttgctttatgaatctgggtgctcctgtattgggtgcatatatatttaggatagttagctcttcttgttgaattgattgctttaccattatgtaatgtccttctttgtctcttttgatctttattggtttaaagtctattttatcagagactaggattgcaacccctgcttttttttgctttccatttgctggtagatcttcctccttttctttattttgagtgtaggtgtgtctttgcatgtgagatgggtttcctgaatacagcacactgatgggacttgactctttatccaatttgccagtctgtgtcttttaattggctcatttagcacatgtatatttaaggttaatattgttatgtgtgaatttgatcctgccattatgatgttagctggttattttgtccgctaattaatacagtttcttcataacaatgatggtctttacaatttggcatatttttgcagtggttagtactggttgttcctttccatgtttagtgcttccttcaggagctcttgtaaggcaggcgtggtggtgacagaatctctcagcatttgcttgtctgtaaaggactttatttctccttcacttatgaagcttagtttggctggatatgaaattctgggttgaatattcttttctttaagaatattgaatattgacccccactctgttctggcttgtagggtttctgctgagaaatctgctgttagtctgatgggcttccctttgtgggtaacctgacctttctctctggctgcccttaacattttttccttcatttccacctcggtgaatctgatgattatgtgtcttggggttgctcttctcaaggaatatctttgtggtgttctctgtatttcctaaatttgaatgttggcctgccttgctaggttgggaaagttctcctggataatatcccaaagagtgttttctaacttggttccattctccccatcactttcaggtataccagtcaaacgtagacttgtcttttcacacagtcccatatttcttggagactttgttggtttattttcactcttttttctctagtcttgtcttcttgctttatttcattaatttgatcttcaatcactgatatcctttcctccgcttgatcaaatcggctattgaagcttgtgtatgcttcatgaacttctcg

SEQ ID NO: 12657 - DNA, 6066 bp, Homo sapiens
tttttatgtagcttttttttttcttttattattatattttaagttttagggtacatgtgcacattgtgcaggttaattacatatgtatatatgtgccatgctggtgtgctgcacccactaacttgtcatctagcattaggtatatctcccaatgctatccctccccccaccccccaccccacaacagtccccagagtgtgatgttccccttcctgtgtccatgtgatctcattgttcaattcccacctatgagtgagaatatgcggtgtttggtttttggttcttgcgatagtttactgagaatgatgatttccattttcatccatgtccctacaaaggacatgaactcatcactttttatggctgcataggattcgatggtgtacatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggcagggttaaatggtatttctagttctagatccctgaggaatcgccacactgacttgcacaatggttgaactagtttacagtcccaccaacagtgtaaaagtgttcctatttctccacaccctctccagcacctgttgtttcctgactttttaatgattgccattctaactggtgtgagatggtatctcattgtggttttgatttgcatttctctgatggccagtgatggtgagcattttttcatgtgtcttttggctgcataaatatcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtacagaagctctttagtttaattagatcccatttgtcaattttgtcttttgttgccattgcttttggtgttttagacaggaagtccttgcccatgcctatgtcctgaatggtattgcctaggttttcttctagagtttttatggttttaggtctaacgtttaagtctttaatccatcttgaattgatttttgtataaggtgtaaggaagggatccagtttcagctttctacatatggctagctagttttcccagcaccatttattaaatagggaatcctttccccattgcttatttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgagctcttttttggttccatatgaactttaaagtagttttttccaattctgtgaagaaaggcattggtagcttgatgggcatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagtcaatggagttttctagatatacaatcatgtcgtctgcaaagagggacaatttgacttcctcttttcctaattgaataccctttatttccttctcctgcctaattgccctggccagaactaccatcactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttctagcatgaatggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatattcatcaaggatattggtctaaaattctcttttttggttgtgtctctgccaggctttggtatcagaatgatgctggcctcatcaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagggtgtatgtgtcaaggaatttatccatttcttctagattttttagtttatttgcgtagaggtgtttgtagtattctctgatggtagtttgtatttctgtgggatcagtggtgatatcccctttatcattttttattgcgtctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatcttagggtgtcaattttggatctttcctgctttctcttgtgggcatttagtgctataaatttccctctacacactcctctgaatgcgtcccacagataatggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttgtggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgcaagtcactcaggacttgctttatgaatctgggtgctcctgtattgggtgcatatatatttaggatagttagctcttcttgttgaattgatccctttaccattatgtagtggccttctttgtctcttttgatctttgttggtttaaagtctgttttatcagagactaggattgcaacccctgcctttttttgttttccatttgcttagtagatcttcctccatccttttattttgagcctatgtgtgtctctgcacgtgagatgggtttcctgaatacagcacactgatgggtcttgactctttatccaatttgccagtctgtgtcttttattggagcatttagtccatttacatttaaagttaatatcgttatgtgttaatttgatcctgtcatgatgatgttagctggttattttgctcgttagttgatgcagtttcttcctagtcttgatggtctttacattttggcatgattttgcagtggctggtactggttgttcctttccatgtttagtgcttccttcaggagctcatttagggcaggcctggtggtgacaaaatctctcagcatttgcttgtctgtaaagtattttatttctccttcacttttgaagcttagtttggctggatatgaaattctgggttgaaaattcttttctttaagaatgttgaatattggcccccactctcttctggcttgtagggtttctgccgagagatccactgttagtctgatgggcttccctttgagggtaacccgacctttctctctggcttcccttaacattttttccttcattgcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccagtcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtactcccgtagctcagagtaatttgatcgtctgaagccttcttctctcagctcgtcaaagtcgttctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaatactctgccgtgtgaggtgtcagtgtgcccctgctggggggtgcctcccagttaggctgctcaggggtcaggggtcagggacccacttgaggaggcagtctgcccgttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaagcctccttgagctgtggtgggctccacccagttcgagcttccccgctgctttgtttacctaagcaagcctgggcaatggcgggcgcccctcccccagcctcgctgccgccttgcagtttgatctcagactgctgtgctagcaatcagcaagactccgtgggcgtaggaccctccgagccaggtgtgggatataatctcgtggtgcgccgttttttaagcccgttggaaaagcacagtattcgggtgggagtgacccgattttccaggtgcccttcatcacccctttctttgactaggaaagggaactccctgaccccttgcgcttcccgagtgaggcaatgcctcaccctgctttggctcgcgcacggtgcacgcacccactgacctgcgcccactgtctggcactccctagtgagatgaacccggtacctcagatggaaatgcagaaatcacctgtcttctgcgtcgctcacgctgggagctgtagacccaagctgttcctattcggccatcttggctcctcctccctttttttttttgagac

SEQ ID NO: 12658 - DNA, 43886 bp, Homo sapiens
  misc_feature (40594)..(40594): n equals a,t,g, or c
attttctggacttgtgtcctcctctctaaaaatcagttagggcaatcaataggatctcttctggctccaaacttttttgtttctatgtatttgagctaggtggtgtaatatgatttttttgttgttgttttatctttaaagtcacttgttttaaaatcacttttcttcttgctattttagagctttcacatattataaaatggggaatctggacaacagaatagctaatccagaccagctgcttacacaagatgtagaaaaattttgtaacagtgtagtcgatctgtattcaaatcttagtaaggtaagtttctctcctttttaaaagattatttgtttaattttttgaattttgaatctaagcaaatttatatagaattgattttgtggacataacagcagcatgtaaatatttaatgcttttataagaaaattagagttgttgtaatagttttaattattttaattttttctattatttttgtgaggtactttggcaaagaactgataatttagtgtcttataaggattttctaagaattttgcaggttgattccattaaaacaacagaaatttgaattctcatcttttgacctgtgtgcatccggccattgttagagattgactgtcaatttatgtttctaactccacacttataacactagactaggacttcctttctgcccatttctctgcttcagtatctttaattctaatagatcattagtaagtagtagtcaaaaaatttcacaagatgcaagtatatttcagttttctaattactgtttttcccattctcctcagaatattgccaaagctcctgactgtgataggccttagtcagttttccttcttctcactgatttctccagttcttatcttagtcatgttatctcaccacccttacagcttttgctgtagtcttcttattaaaccctcttctttgccattacctcttgcattgactatgatatgtagtaggcacctataaaatagtctgcccagcatcccctcccctcttcatctgagatgcttcagttcccactctaactcatgtgacttcccttggtgttggctaggagcttgtctcatactggaccaatgatagtatctttgcctctggtcacagttgacctagatatacagttttgagacaaaagaaaaccaaaactataaaaaggactgggtcacattgtaagaataggaatgttcttgcttcaaccagatggatggagggaaggcaattcttagagatatatatccacaagagctgctctcctcatgcccaggcccaatgcttttcacttccagcccaactttgttatttatttagctctccagaagcctttgctaactgatcccaaactcgggaactctgacaactacaaatagttcagtaattaagctttcttttctgttcccattaccacatttgaaagtttgttctctctctttctctctctctctgtctctgtgtgtgtatgtgtgtgtgtatgcatgcatgcatggtgggaatggggggtgtatctatacaactttccatgtaattttatagacattattatgtattctttaaatcttggcacttgagcaagtctcaggttttgtcaaatctggaatacagaagaatattaaattaagtacttgtagtggggctgtacaccagtgtgtaagttagatgttttaaacatctaattgacctccaacttaaattatgagtcattatttttgtcataagttttaacagttcttgaattttataagtatctctagcttcttgataacttataaggcaaaaaaaaaaaaaaaaaaaaaaaaaaaggaaggggaaaggtagatgttgaaacaagccagttaacaaaccaagccatctatcctagtaataatgtggattagaaagtgctggctgttggccgggcatagtggctcatccctgcaatcacaatactttgggaggccaaggtgggcagatcgcttgagcccaggagttcaagactatcctgggcaacatggtgaaaccccatctacaaaaaatacaaaaattacccaggcatggtaatgtgcgcctgtactcccagctactccagaggctgcagtgagccaagatctccagcctgggtgacagagccagaccctgtctcaaaaaaaaaagtggaggtgcaagcagtggctgttgacttaaagtgaatgaacacaatttgtgtttcttgaaaaacatttcaaactaatgcagctgatggtgcattagttgagttgtctctgtgtgtaaagagcagtacattaatgtgttattttggttctagagacttgagttttatatcacaaaattagattcaatggcttacttgattattttgccatggaagtgataaagtaatagagtcaaacaatattggagcaggaaaagctcctcactttacaggtgaagatatgtagaaacaaactggtagcagatttggggttacatctcaggtcattttattcagtgtctttacattatattgacacattactgagttactagtggttaattatcacagtagaggtatcttagttgatggaaagtgataaatgtttttcctacttgatggtcagtagacattgtgtaagctgttcccattttaagtttcttgagaggaaaactgttatctttcatgtattctttgatctacttactatcacagtacattgtacatagtgggacctctacatgttgataattatatattaaatgtttaatgacattttatagttaacatgttgtattagctatcattctagtgctttagttttaattctgtgtattctaatatttattttacagccatttttagacatagttttgtatatctttaagttaacgagtgcaattggagctcaggtgagtctgcttttatttcaacttttaaattgatataatataatatttgaaatacatattgtgaatagcttgatggcctgtaagaatttttgtagatctcaaagaatgtattttcacatgatttacctaacaaagtctggttataaaataatacttcattcgagattttagaagtactaatttttctttttaattttccttaaattaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaaacagaagttcttaaaccatgaatatacttgtacttattgtttcaaagtaatgtctaaaaagagatatggagacatccattttaatatgaaattctaatgttaaaataacgatacatttagagtgggtgtaacagttccaagaatattttataatgtaaatggttggctatcccatgagccttattatccaagtctctgatatttgtgatggcaagaatcacttttaagttttctttgagttatcttattgaaatgtaactttagtcatttaatatgtaatgttattgttacatatttataacacagccatataatagtatggttgttttacatatgtgtatgtgtgtatatgcatttcagttgattaataaattatttccatactggtttttgttgctttccaaaacactggaaaagcagggttttggttttgctttgttttgtttttcgaatttttctgtttattttcctaattctttgctgtcttgtgatccaggttttatcattcttgtattttgttttactataaccaagtgaataggccaaatccttcttgtctccttgcagtcatatttttatggtacttaactacatttttgtgatacttaaatatgtctccatgtctacttgttatctgattctgcatttcttaaaggcagaaactgttttagttatctttttggtccacatttgtagtagttgttgatatgcattgaattgatcagatttacttttttttttttaatcttgaatacttactagcacatatattgtgctagatagtaggaataaaaagataagtaagacacaattcctgctgaagaggaattacaatgtggtaaaacaggtagatagtcaaacaattatgatgcagcatgataaagtttagtaatagaagtttcaagaaagtatttagtgccaagaagaactggaggtgatatctgagctactttggggaggtaagtaaacatccattagattatgtcaggcttgccaaacataagaacaacctcactgaatggaaactgttcaggaaacatttatatattttagtatggcagagtatagggtatataggggaatgagggaagtgcctatgatgaacttggaaaggtatgcttcaagcatacctttctttttctcttgggatggtcaatgggtgatgaggtcacgtacaaagttattaatacatagtacagcagctggaagcaagatgtacacgcagggaaagacagagctcgttcagggggagctgaacttgaggcatctgcacagtattaaggtaaagatgtgtagtacttatttcttgggttcataagagtgataggactagaggtatagatttgagatgagaagagaactaaggaaggagtttgagggaatattaacattaaaaaagaaggcaagaaaaagaggtctaagaattattgtggaatcttaagagattatcaagaagagttccaacaggagagtgttagataacatagaaaaactgtgaactgcaattaggagtttttaggtgagcaaaatgtaggagagctgagggataagctacagtggtaagaggaaaagcccatgagtagtaaaagtgtagaggctactgtgtactttttcagaaaaaaaacaaagggaaaaaattacccagtagggcaatttctttcagtcattgaggttaattataaaaattgtacatgtttgtatctaagtgaatttattattatatcccagaactttgtgtatctttctctcccaataataatagggcccagcgagcatgatggcctacttggttgtttctgggctattcctaactcgacttcgaagacccattggtaagatgacaataactgagcaaaagtatgaaggagaatatagatatgttaattctcggctcatcacaaacaggtaaagacaaatgcattaaagccttgctaaaaattaatttctatggatattgatgtcatttaaattgactccaaaaagtctagtgacactgttactgtaataatgtgcatattgtgttgaaaatatacattatgaaagagactagttttataaagtagtaatcatgaatattttgaactctttttcttactaaccatgtagtattcctgattcacctgttcataccttctgttgatgaattttctgttaattttacttcagacataatcagtttacaattcaaatttcaacttacaatacctgttccaagacaattttgtctcaatttttccacaaatatttttattttgactgttcataatgctcaatgattcactgtcactgcatgtgcctctacctattttctagagttttttaaatgtaagataggaagaaaaagtgtggactttggagccagccatactagcttcaaaatctacctcttccacttatcagttgcatgtatttgattttagcgaattattcatagtttcacttttgtttataataggtagataatatagggttgcaatgaggattaaatttgataatacatataaagcttccagctcagttttttatatggagcaactgctcaataaatgttctcatatattgatctgttaatgttaagtcattttgagggttctaatatgtatttaatattctactctataggcatttgcaaatgacagttccctcttcctttatttccttggattgctaaaatagtacaagttttaaatagggttttttgctctagggaggcagcggaatagagttaagaggtgatttgccaagtaaatgaaagatgccttttagtgaaagaagcagaaagcatgactcatggctccagtaataagaacactcactgcttcacgtgagaacccttaagacagggcagttccaggtatggcattatcagggctctggctctctggtgttctcttggctctgccctgctttgtatgctgccccattcctcgggctaattcttcttgtgaccacaagatggcgatagcagttacagatttcactagctcctctcccctgcagaaagctccagaaacaaaaaggggccatctcgcctggtgtgtctttatgagagcaaagaaacctttcccaagagtcccacaactgactttccctcatatcttattggctggaatggttacttgaccatgcctaaagcaatcacagcaaagtgattggcttagaccagttgggaccctaaatggggttgaggcattcctaaagcattagggtacatggaaaataatagataactttacaaaagttgggattattttaggaagaagaacaatgaagagaatagatgttggatgggcagccatcaatattccaggatgttttatcctttcagatttttcattaaggctaaaatgactcagttcaggaggagaatcctcacctcatcttcttccataggcttaggtgtggagaggagatagaaggaagtttttttaaaaagtaattagaggtatagaattgtaggcttcttatactcttgagtctctgtcattgtgtcaaggaaaccatgaaacgcgtgacaaatgtgtcatatcttatgggaagttaattttacttgaagtggttgaggtaggtggtaccttgtttttatgaaaaacgcaggtccatttcaaaatagaaatataaaacataaattgtttaggggaaaaaagagactttaaagaaatatttcaaccttgccttctagacttctctataaatatttttctctgccataagaggtactttgctgggaaagcttacatcattcctgtgtaatagaaagactataaatgttagggtcagataggagttatgatttcagctccctgacctgctggctctgcaacctttacaaatttacttaactacactgaacttctcttcatctataaaataccttttttttctagtcgtgatccctgtggcccttgtggacccatgcacatctgctcaggaaacgtggaattgttgtgaggatatgatggggttccagggtttcctcctgggagctggcactttgaagccggtgggacttagcctgcttttctgtctttaaaaggctgtatgtcaagtcatcactatccatctttttctagctgttgctttttcatctctttcttgtttgggcctgtactttaacttgaagtctgcaatgttggtcccagccctgcctttctgtacatcacagcaacttctttctctaatttcgaatttctgagaattcgtgcagtatgtcttttgcagccaggatacctatgccataggttgcagtccagcatatgattcagtcaggagtgtattcctgtgctccgatcagctgagctaggaacagaatctcaggtatagactgtggcttgagatgcaccagataagctcttagtcacaaaatgtccatttaaatacaaacattcagccatcatatactgtatttcaattattttccaagcataggtaacattaaaattaattgctaaattattttctttaatagtgaagaaattgccttttacaatgggaataaaagagaaaagcagacagtccactcagtcttccgaaaactggtaagataacacacttgaggttcatgtgtttatggaaagggttttttttgtttgtttgttttgcctatggccgacacacatacacacacacacaaacacacacgtatgtatacatatcttaaagattttttgaaaaatagctataaaggattttatactgcatttttaataaaaaatatgagattaaaaactatcatatcaatatattcaagtgcccatttataaaattgcatagatttattaaaataatattaagtgtaccatctgatctttgacaaacctgacaaaaacaagaaatgaggaaaggattccctgtttaataaatggtgctgggaaaactggctagccatatgtagaaagctgaaactggatcccttccttacaccttatataaaaattaattcaagatggattaaagacttaaatgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaattttttgcaatctacccatctgacaaagggctaatatccagaatctacaaagaacttaaacaaatttacaagaaaaaaacaaccccatcaaaaagtgggcaaaggatatgaacagacacttctgaaaagaagacatttatgcagccaacagacacgtgaaaaaatgctcatcatcgctggccatcagagaaatgcaaatcaaaaccacagtgagacactatctcacagcagttagaatggcgatcattgaaaagtcaggaaacaacgtgctggagaggatgtggagaaataggaacacttttacactgttggtgggactgtaaactagttcaaccattgtggaagacagtgtggcaattcctcagggatctagaactagaaacaccatttgacccaaccatcccattactgggtatatacccaaaggattataatcatgctgctataaagacacatgcacacatacgtttattgtggcactattcacaatagcaaagacttggaaccaacccgaatgtccatcagtgatagactggacaaagaaaatgtggcacatatacaccatggaatactatgcagccataaaaattatgagttcatgtcctttgtggggacatggatgcagctggcaaccatcattctgagcaaactgttgcaaggacggaaaaccaaacactgcatgttctcactcataggtgggaattgaacaatgagaacacctggacccagggtggggaacaccacacaccggggcctgttgtggggtgggggcctgggggagggatagcattaggagatatacctaatgtaaatgacgacttaatgagtgcagcacaccaacatggcaaatgcatgcatatgtaacaaacctgcacgttgtgcacatgtaccctagaacttaaagtataatcaaaaacataaaaaaaaaattaagtgtatttttacagaggttgcttaggagccttatttagtgattcccacagaaagaatttgttcctgaagcattcatgaaaatacaataaagattattatgtaaagcaagagtcagcaaactttttccataaagggcaagatagtatgtatatattttaggcttttcataccacacagtgtcttgcaactattcagctccgctactcaagagtagctatatataatacatgaatgagtgggtgtggctatgttctaataaaactttacttaaaaaaacaagtagcaggctagatttggactatgggtcagagtttactggctttttgttttaaagaatataagcattgtttcttgtgaaagctttacttcagtttttatttaattgccacttggaaaatttgaattcaagtacttttattccattatttattcaaaagatattgaatgccgtctagttgcctgtgctcactccaggtgctaaggatgatggtggtggacatgatggataaaatcttgcctttaaggagcttacattttagtggaagtctgaagtttgtgaaattaaatgtatattttagatgagttaaagaggttaaagaaattgtcattttaaattatttcagaaattggatttttgcctcgtcggtatttaacatggcagaacttttagagtgctcactggtagaatgcatttaaggtaatttttcaggggcctgcagttcaccagtttgctctccacacggcttgcttattctcatcctttagattttcagcccaaatgttaacaccttattgaagctttgtcttctctgatcagcctatttgaaatggcctccaacagttacttcttgttttaatcatcatctttccttaaaagtatatatatatttgcagtcaaccctctgcatctgtgggttccaaatccatggattcaaccacacagattgaaaatattcagaaaaagaaattgtgtctgtacttatgtacacatatttttttcttgtcattattctctgaacaatacagacattagtgtaatagctatttacattgtattaagttttataagtaatttagagatgacttaaagtgtttgggatgagccagttgcggtggctcacccctgtaatcccagcactttgggaggctgaggcgggcagatcagttgaggtcaggagttcgagaccagcctgaccaacatggcaaaaccccatctctactaaaaatacaaaaattagccggttgttgtggcgggggcctataatcccagctactcgggaggctgaggcaggagaatcactggaacccaggaggcggaggttgcattgagccaagatggcaccactgcactccagccttggcgacagagtgagactctgtctcaaaaagtaaataaagtgtatgggatgtcgtactcaggtatatgcaaatactatgccatttttcatcagggacttgagcatccatggattttggtatccagaaggtcctggaaccaatcccatcccctttggataccgagggatgactgtattacagtctctaattatcttgtttactagttatgctctttcattagaatgtaaactccataaattcagggaccttctctgttctattcattgtatctccagcttgagcacagtgtctgacacatggtagtcattgaataaatgttccagagattgtctagttgcagaagataccaagttgttaacaagctaccctgtactcaggaagccacattttagtggagcagacaataaataaacaactagatgttctgtataatttcaggtagtaatgaattcggtggccaaaaatgaagcaggataaagggatagatatgaagggggctattgcccagctactttagctggaatggccaagatctttcttgaggaggtgacatttagtcagaaatccacatgaaagtgaaggagtcacaaaatatagataccttagaagaatgtattcctggcagtgagaagagcaagaggaaatccttaagaaggtacatgtttgagaaaccgttatttctggagcttggtgaggaggagcaaagtagaagcatatgaccttaaaaatagagctcagtgccagatcatgcaggaccttgaataatctggtagatggacagtttgagaacactacaactccagaataaaaaagcagttttagacttgtagttttaagacaatgcgtgctcatgttaaagctaaaactgaggctgtgtggcactgatttacattagcactcagttcagattgggtgtaatacaattcttagataaagcacagaccatgtgtctccactgaaagcaaagcattcagtgccaatccggacagctagtgtttcactcaaactagttaatctctgttctttttgctttcgttgttgtcctcttttgggatatgtgtatccaaaagcatggtgactacaatagcattgtgctattgcatgcaagagaaacagcattgttaaaattgtttatgtaatttccatgctgtttgcataaaaatggtttcatgaagtgtttgtttggcacccgctctgtgaagagcattgtcctcggtggtgtgatgtacaatataaacagaatataaacagaaatcacgggcactcagtaaatatttgttgaataaatgaactatacagtttgttttatccttatagtagattcagttttttatacagagaaaaagatggttttttgtttttgttttctgccaggtggaacacctacataatttcattttgtttcggttttcaatgggcttcattgatagtattattgccaaatgtaagtatattttgaaagagatgagatttgtggaaaaggtgaaatactgttactgttttaaatcttacctgtttggtttcagaccttgccactgttgttggttacctagttgtcagtcgccctttcttagatttgtctcatcctcgacatctcaagagtacacattcggaacttctagaggtaaactgatgataatacaatgaaaatgtaacagtaaaaataaagccaaatttttagtcatagaaactataagtaaaaactaatatttatttctatttaaggattactaccaaagtggaagaatgcttttgcgaatgtctcaagctctgggtcgaatagttttggctgggcgtgaaatgactagattggccgggtaagattagtaataatgagctgttgcagaaaataatttttaaaaatatattatccttaatgattgtatcagttgagattaagataaggggtcaacatttcctagcccaggaaggtggttttgatagaaaattaaggagatttttctgatggtgaacttttcatgtttcttgaggacagctggtttgcgcagtacagtagattagaggctgtcaagttgtttgctccatggacacgtatttgctaagttgggaaatgttgaatcatggcagtcttaattcacagaaaactatgtttatgaatagaattttctcatttaaattttcttgtcctctaccatacctttttttcttggatcttagataccggcaacctagcaaaacagatgaatagaaatgaagttgactttaatgggaattcaaatgagatgttatcttgtatctgtaggcgtgcttgtgaatgtagtcatattatctagtagtaaaattatctttagacagtagaatgaaattaaatattaagatttcagtatttcaatctccaatataaagggcatggtatggtgtaaaaaacaccataaattttaggtcacctgaagaagtttgatgactgaatatctttcctaggcctgtgatccatcttcatatttctctttttcctccttcttagctcctgtggcagttatggtcttcatgcaatatagaagttgttaactactatgagtagagtctctttcatgagaatactaacattcttcctacttgttaacttttcttatggctttacagttcatggtatataaggtgcttctgttcctttagggtgtttcctttcactctctctctctctctctcgctctctttctgtgtgggtgtgtgtgtctttctctttcactccctcccttcgtctccctgcccccctttctttctcttttttccactttgttgaggtatgattgacatataagaaactgttcatatttagtgtatacaatttgatgaatatgggaataagttatacacgtgtgaaaccatcaagaccataaacattcatcacctcccaaagtttgctttaggaggtttctgctttttattcagagaaaaatcctgttttcttcttcgatgcagaatactttctctttggcgatcatggtcatttttgttatctccaacctcttgtcgttagttttgatttttctctattgccacagtgatttctatctaataataagaactcatcatctttcccctcttcagagtaagaaagagggaatctttcagattcttccgtttgcaggaaggcagcatgcattcggcatacatttaataaatgccttccttggatagaaagaccagctttatacatggctttataggtcacttcagcaagagatcagagtccatacttcctgggtctaaggaatatactagtagtggtccttttgtagtatccaagagaaacctcctgaaaattctcagcaaataactgccttgacttggctattaatgaagtatctgttgagttggggatcctatggaaacctcttccttcatccctatattcctgctctcctactgaaacataataaagcacacgttatcattaatactttatgttgatgagactgttaggttacttcatttatactaaattataattttaggaacttcagtttgtataaaataaaagatgtgacaatagtctggagttttgattatggtttccttttctaaaattttagttttactgctcggattacagaattaatgcaagtactgaaggatttaaatcatggcaaatatgagcgcacaatggtctcacaacaggaaaagggtaaatatgagtgtcacagtttaaggtcacaattttaagtgtttgctgacataatatgatgctttaatacctattttccatttaaggtattgaaggagtacaagtcattcccttgatacctggtgctggagaaatcattattgcagataacattataaagtacgtacagaaaaaggtcttttagcaccataaatgtttgttaaacttcatagtagtctttctttttcagcttacaattgcttagtgtttaaaattatttctgcttttttaaaaaacagcttagaggtatcattgacctaaaaattgtgtatattaatatttaaagtatgcaacttgatgctttgatatctgtgtatgttgtgaaatgattacgttttggctaattaatttacctatcgcctctacatagttaaccatttttgtgtgtgtttagtgagaatttaatttagatgtgtcttagcaaatttcaggtatacaatatagtattttctactattgtcccagtacagtggatctacagaatttattcttctggcatcactgaaatgttgtgccatttgaccaatattacccccatttcctctctctctaaccccctggcaaccaccgtcctactctctacttctatgagtttgactattttagattccacatacaagtaagatcacatagtgtttctctttttgtgtcttgcttattttgcttagcataatgtcctccagatccatctatgttgaaaatggcccagtttccttcttttttaaaagtggggtaatattctattgtgtgtattttgtgtgtatgtgaatatatacacactgtacacactatattttctttatcctctcatcagttgaaagacatttaggcagtttccatatatggactattgtaaataatgctggagtgaacatgggaggaagattctctttgagatactgattttatttcctttggaaatgttcccagaagtgggattgctagatcatacggtagtcctaattttaattttttgaggaacatccatattgttttccataatagctgtactatttgtagtcccaccaacaatgtacaaggtttcctttctccacatctttgccaacacttaccgtttgtctctttgataatagtcatcctaacaggtgagaggtgatgtctcattgtggttttgatttgcattttcctgatgactgagatgttgagcaccttttcgtatgcctgttggccatctgaatttcttcttttaagaagtgtttaagctctttgcccattttttaatcaggttatttgtatttttggtattgagttgtattagttccttatatactttaaagtaattctctttttaaaaatttcctctataggtttgatcatgttcctttagcaacgccaaatggagatgttttgatccgagaccttaattttgaagtaagtttttaaatgatcatataaaagcttaaatcatctttaaaatgtgaactgaaaaagattacctgaatatttaaagtaactttaaggctcgacttagtctctgaatccacagaattgctttaaaaagtaagtctttgaaacgcttagaaatctatttttcttaattgacaggacttcaaaatttcaaatactactaccaaaaaactttttgcaaatgaagtttatgtcaagaaagtcatagaaaatatagtaaattggagtctccagtgtaaaatgagtatttaaacacacaaatataattttagtctctttacattaaaaagaaacttatggtgtggctggtattgttgtgactgtacaggatgatttgtacctataaaaacaaaatacagactgttttattactgatgaaaacgggaagagccgcacagtagcgctacaaatagacactcacctaaaacaagtaaaatcccatgccaagtgaaaactgatgttgattcaatatactctgctaatgaaatgggatatggcagaccaaattaaaaagaaaagacaaaagatgaatgtttttgtacgatttgtaagactcgcagatttaagggttactatttaggttttctctatgttgtggctttatgaatggttcagatccagaaatcttcataattagtaacaaattcctatcacataggctatgttccccattctagacaccattcctctagaacaacactttcccgtagaactttctgcaatgatggaaatgctctatactttcactgtccagtaaaataaccatgtgtagatattgagcatgtgaaatgtgactagtacagctgcaaaactgaatttaaaatttaatttaattaatatgatttaaaattaaatagccacatgtgagtagtggctatggtattggacagcacagctctagaattcctctccacatgctaatgtgcatggccatctgtagtttgtgtttcatgtggggatttttttcctactgctttctttgaaggaatattgtctgatagtttataaaataaagaatataattattggacttgtttttaatttgttacagtcttaagtaagtcttcagttttctgctcttagtaatttatattaagcacatgtctactttcttctcaatgaattataaaaatgaaaattgttagttatgcaaagtactttgaacttattcaacaatgagtattctatcgttatcatatttattccaaagccaggaaatacaagaagtacagaaaatgtaaatgtagttggtaaatattgactggctccacatatcacagaagtgttttctcacatagctccaggtacttcagtcacttgaatgttcctttggcaaagtaggtagccaggcttgatttccagtagcccctttattgccactgtccaaggataaaaaggacgtgagacttcgttgaagaatgcctcttgtccctttctcctacttaccctcacttctgtctttatgcagaaataaaatataccaataatataggggcacacatgactgaagcacaatgagaaagggggttgggatacttagaatagatggatcatgattatggtccataataatattttgtcttgatgttaccacactaaagctgtcactttctttttagttcaaagccttttcttttaaagcccttatgtttgtattgaatagacttctgtcgtttctataatttcacttttatagtcttaaaaatgtcctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcagcctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaacaatgctcaccatcactggccatcagagaaatgcaaatcaaaaccacagtgagataacatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggataaagaaaatgtggcacatatacaccatggaatactatgcagccataaaaaaatgatgagttcatgtcctttgtagggacatggatgaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtggggtcctgggggagggatagcattaggagatatacctaatgctaaatgacaagttaatgggtgcagcacaccagcatgtcacatgtatacatatgtaactaacctgcacattgtgcacatgtaccctaaaacttaaagtataataataataaaattaaaaaaagaacaataactaccctgtattaaaatacatcaaaatgtttaaattaatgagtttattatgatactcattatgttgaaaagtgacaaagggaaaaaaatgtctttaattctttctcttttttgggtttcatttggaaagtcttgagtccccacttatgtccttacttgttggagtgttttacttcataaccatgttccttacttcctggtgtttatcctgtgattcttgttttctcctcccctgggaactgtttctctgacttctttttggttcactgttatgaattctaatctctttctgacttaaagtattctaaagtagacctgggtttctcacattcattatgtctttttattgtttttcttaacatagcctttctataatcaacaaatgttcttcagttctttgcagcctctaattattttctactcatctggcttacttgaaaataaagatttctttctcttggaaagaggcataataaaacagacttggcccctcaaataaatctttcctactttatgattcatttgccttttgggttacatttgtaaccaaataataaaaacttctttggaataagagattttataccattttccattataaactccccagtacagacatatttatctgtctagatattattctgggaagtatgtagactggagagatcctaagaggtaacagcttgcaggttaccatgtggggattaaaatagtactttgtccaaggtgggcggattgcttgagctcaggagtttgaggccagcctgggcaacatggcaaaaccccgtctctgtgaaaaatacaaaaaaattagctaggtgtggtggtgcacacctttggtcctggttacgcaggcggctgaggtgggaggatcgcttgtgccagtgaggcagaggttgcagtgagcggagatcgcaccactatactccagtctgggctacagagtgagatcctgtctccaaaaacaagtactttgtaagttactaagatttttaccttttcagtaaggtatacttatagtgtttaaagaaactaattaatcttcataaacaccatacttttatataatttttcttttacttaaatttatgtgtagaattttttatttgttatgataaatttatagaaagtaggatttatcaaggagtattatttggggggtatatttttattggtaagaatatggtagttcaaagcattggttgatccggtaaagcattctgagagccccaataatacaatgctgttaagaacttaattttcagtaaatgttactcttggcttttagtcttaatttaaccccacaaaaatatgtacttaataaatttttaatacagaaaaattatcactggcttatcatggctgacgtcataattggaagttttgttcaacactaccaaatgccgtgaagtaaagaaaagtgaatgctgagtaggttagccaggcttgatttagagcataaaaggataactcaggatttcagtaagtctggttattatttatatacatcattacaaatctgtttttggggtttcctggcatactgcaacaaataatgtggaagggtattattggaggcaggaatattgatgccattgtaaaccacaaagagcagttaggaggggagaatttatatacggccaacattactcaaataaaacgtagcagggaaccatttaattaccagctcactgaactttaggaccttctaagggcatcgctgttacagtagagtatgattattttatatgataaccttgctttatgaggaacattcagtatattcaattttatgtgataaggaaattgtgttatttaaaaagaagtctatcaaaatgattctttatcagaaaaaagtttattcatctgaacgactctttaacaattatgtgtgtaaattgttattttcttttagatcaactatgtgttaggctgcttcattcttttttctttaagaagtttttaaaatgtaaaaatgaaatttggctttttaaccatttctaagtgtataatttagtggcattaagtacatttacagtgttatgcagccaccaccactatccatttccagaacttttccatcatcccaaatagaaactctgtactcattaaacagtaactctccttccttcctctcccttgcccctggtaacctctcatgctgtctgtctatgaatttgactgctctaggaatcacatataagtgaagtcatacagcatttgtccttttgtggctggcttatttcatttagcataatgttttcaaggttcatctgtattgtagcatgtgtcagagtttcattcattttaaaggttgaatgccatttcattgtgtgtgtgtgtgtgtgtgtgtgtgtcacattttgtttatccattcatcctcttgggtcgcttccttgcttccaccttttggctattgtgaacaatgctgatggctctccattttgtcacagtaaaagtcgaagttctttcaatgcctgccactaccctacccctacctgatacatctctgatctcatttcctactattcttctttcctgttcattcttcagtaaaatcagccttgtttctgtttttttttttttttttttttttttttgaataggatagctacattcctgcttcagtgcctttgtaccagcaaattttttttttttttttgagacggagccttgctctgtcgcccaggttggagtgcagtggcacgatcttggctcactgcaacctctgcctctcgggttcaagcaattctcatgcctcagcctcctgagtagctgggattacaggtgcccgccactgcatccagctaatttttgtatctttagtagagacagggttttaccatgttggccaggctgtaccagctttttatgggtggtaaaggtgggggctagaacagtcttcttttagttaaatcctaattcaccccttctttcaaagttttacttagttgtcatattcaataaagtctgctctgaccaccttaaaaatgcggctttcctcacccgctcccaagttccctttgtctgttttttcctccaaagtacttattttctaatatactatttaacttatatgttatgtatattctttattgtatgtctcttaccactagaatgtaaaccagtaagggtagaggtttttggttttttgttttcattttttgtctctttaattcattaatatggcctacttgcctagaacagagcctgacagagagcattcaataaatattcattgaattaaataataggaacagaaggctcaccagcttaacaaatttgttaaaggcaggttaccagctagggtaactcatatctttctgatattttctttcctattgtgttgcattggtgtttagtgttgtaagctagaattatagctaagattttctgattctttacagagttgatcagatacttacaagatcataagcctagaacttaaccactctttacattttctcatttatctttatgttgttgcagaataatttagtgacacttgtatatatttatagtgcacatatattttgataaaacacttataatttctaagaatggaatctacagaaacattgcttactgttacataagttgctgacttgtacactcattgcaatattatctagaagagcaaaacaaaatgcagatgacctaaatatttaaccaaaggggagtgtttaaataagttatagtatatccttactatggaagatgcttgaggcattaaaggaaaggaatgggggaatctgaatatactgacctggaagaatatctgtgatatattgttaaataataaaagcaagttgtagaacagtctatagagtacgttttcatttttttaaaagagactgtgtatacgcatgtatttattgttttcaagaattctcagttttctaaactttatctctctttatcttaagttgatgatatcaatcagtcagtaaatttatttatttatacatgtatatagatggggtcttgttctgtcagcctaggtgacatcatagctcactgcatccttaaactgctggactcaagcaatcctcccacctcagcctcccaagtagctggggctacaggtgtgcaccaccacacctgcttaattttttatttttattttttgtagagatgagggtcttgttttatttcccaggttagtctcaaactcccagtttcaagcgatcctcctgccttagcctcccaaaatgctgagattatgggtgtgagccacagtacccagcaataataattttttaagtgaaaaaaaagtaatggtaaaaattggaagtaaacaaagtaaaaggtcccttcacaatacctcttcactgctctacctaatgctacatttacagacaaatagaaggcttataattagccaggagctattaatatttgagtctaaggaaatgttgattaagtatatgttaatttgatttaattacttcacagactgatttttttttttttttcaggttcgatctggggctaatgttctaatttgtggtccaaatggctgcggaaagagttcacttttccgtgttcttggtgaagtaagtacaagttggcctcaaaattttgcagtcttattttgccatactgtctaccactttgtaaattttacaattgttcttctcccttctctctctttaatagttatggcctctttttggaggacgtctaactaaacctgaaagaggaaaattattttatgttcctcaggtaagacctagcttgagttatctttgatctaaagatctttttgtttatttattttttcatgttgcttctaattgacttttgctctactactgtcagagaccttacatgacccttggaacacttcgagatcaagtgatatatccagatggacgagaagatcagaaaaggaagggaatttctgacctagtaagggaatgtttatatcctagatccactgaaaatactccagattatttattttaatcaattaagtattttaaatgccaggtagtttatcttaagctgtaaagccttccaaagctgtaaattgtgattttctaagctgaggtaagatgttaatcccttggcttaaaaagagtttaatcttaacctttacaccattgtttgttttctcattgccatcatccttttactgtgtacaatagtgttattctctttaagctactagacatattttgtcaagtttggtgtagatactaggagctgaaaggttcagggctaccttgtgccacattcttttctgaaatgtatcttttaagtggtacagacaatagaattatagtgattccagtttaaaaaataaaccactattaagaatgttggcttatattaagtttaatttcatctttaatcattttgctgaaaggtactgaaggaatacttagacaatgtccagttgggtcatatccttgaacgtgaaggaggctgggacagtgttcaggattggatggacgtactcagtggtggagaaaagcaaagaatggcggtaagtatactgtgaagaagttgcacaagaatgcaactggttccagcattttgattaatcaggacacaaagtttcatcttatatttttttattcagcagctgtttcagtatggattagtttaaattatcataaaagtgcttgaaaatctttaacttgcatgtaaatttggaattctgaaaaattcataaataccctgccagtatctatgaaaggaaaagctgcagatccgactatataccaataatccatttttctaaaagttcagagaaactctgtagctcattattcctgggatataaggtaatcctggctgggttatgaaatttcttctcatgtctcttccctatagacatctcttttgtatcactcaggctattctttctgaaatagctgaaggtattagaaacgatccattcaaattttatctttattctgttcttgcccttttcctccactattatatgtatgtttttgtttcaaggttcagtatctactacttaaagttacttagaatttttaagttttcctaatataaacaagcatttgaaagaaactactttaattgttatgatgactaaacttgtctcaaaccaaaaatatgcgctaaacactacgtagtaagaatgagaccagcctgggcaacatagcaagaccctttctctacaaaaaaaaatttaaaaattatctgggcgtagtggcacacacctatagtcctagctactgggaggcggaaagattgcttgagcccaggagtttgaggctgcattgggctgtgatcacacaccgtggcactccaggctgggcgatagaaggagatcgtctctctaaaaataaataaataaataaaaatttaaaaagaacggtagtttgggtaccttgtcaagaggggcaacttcataaagagtcattttttaactatatatttcatagtttgaatagatccaagcaagagattctcctctccccctgcagagtatggagattagagaaaactgtagctaaggaaagaaagcaaaagaaattggcttatggcagaatttctgacccattatattcaggttatattccacctttttgttacctccgagtccctgattttgcaagttgtttttcccaaaatcatacccactctacatgaggttaatattaacctaatagtgtgacttgcctggctagtgctataacgtgagatgaatctagtgtgaagagtaaatcataaatgagagagataatagctatattcaaaatggaaattaggctgaaggagtgaaaatttgaaatgattaggcatttctagagtcaatttagaagatgactatagaaataactgcaaaaaagagctgcaaaataactttaaatttctgtactatgtcttcagagaaaatggaaggatgtggttcagaaatggacacgacggaaactcagagaatgaataatgaatgtacttaaaccaaggaacagtgtgtgtgtggtataaaagtacaggagggataattttgatttgaagattaggaattcaaaggcgtgcccagagcagtggggggctgaggcgggagaatcacttcaacccgggaggcataggctgcagtgagccaagatcatgccactacactctagccagggcaacagagcaagactctgtctcaaaagaaaaaaaaaaaaaaaaaaacacatgatccataatagaggcgtttgggaaatggggaaagctcacctgtgacaccactgcatatataactggagcatggccaagccattgtctagagaattgaatgtgatgtgtaaaagagagcctgttgttttgtttcagagggtggaaaggagaaggctaacgctacaaatactaacgttggtgaaattaggtaaagattatatatgtgtattcattttactgtcctttcagttttttggtaggattgaaaattaccaaagtagaaagttgaggggaaagtaggtattagaatttttaggaagaacagacctaaaaggcctagccacttagaacagtgagtcagccagggttgctccagctaatgtcacaatttgggatatcttgtgtttctgaccaaaagttatcttttccactccatttttcttgctcttcctatttagtaataacttttcttattttgaattatgaaaaagtatatatgatggaaaagtggaatatttatttaagtataaattgggccaaacccctttaccagagataccactgttataaaatttttagtgtttttttaatccatttttgtaaatctttttttttttttaccttaaattagcaactatccccctttctcaaattccctgagatctctagaatattaatccttccctttccttacaattgttcagtccttttctgtctctgcctcctttcctgtccagtacagacttcataatccagggtgtggcccataggagataagatatatttcttaaggaatgaacagttcatcccttccccttaacttcctttcccactttttgtgtcatcgtattacctaaatcccagcccagttatttgccttggcacttctctaaccgctcttctgagcacagctaaaaaacatcagatgggctcacagcatggcttagcaatcattttacttatttttatccttctctcatttttcatgacaatcattttaaaactaccaattttgggttttctaccccgttacttaacccactgcacttggcagaataactcgccttctacttttcaaagaaagataggctattatttcaattaaatgacagctaatttttattgagtgctgaaaagatgacagacagtatgtcaggcaccttacacaggtgatctcatttcatcctcacaacagtcctgtgaggtaagaactgggaatgcccccctagtttttttttttttttttgagacagagtctcattctgtcgcccaggccggagtgcagtggcacaatctcagcttaccgtaatctctgcctcccaggttcaagagattctcctgcctcagcctcccaagtagctgggattacaggcatgcaccaccacgcctggctaatttttgtatttttttttgtagagatggggtttcaccatgttggccaggctggtctcgagctcctgacctcaagtgatccacctgcttcgacctcccaatgtgctgggatttcatgcgtgagccgccgcgccccattttacagaggaaattgaacttttgtgcaattcagtagctggccaagcaaagacagctagtaaatgttaaagctggtggtgggggctttgtcaggcttaggcaagcagtatggctgcagtgtgcatatgcttattcactttacaacaagcttgtccaacctgtggctcacggacacatgcagcccaggacagctttgaatgcaacctaacacaaattcataaactttcttaaaatcttatgagatttttttgtgtgtgtaattttttttaagctcatcagatatcgttagtggtagtgtattttatgtgtggcccaagacaattcttattcttccagtgtggcccagggaaaccaaaaaattggacactcctgctttacaactttcttgtattgtggcattaagtagctgacagcatagtgggagcgagagagacacatgttgagaaaatgtccatgtcatgtagtaagtgtggtgatgaatgtacgcagagagtcctttgggagcagagaggagaggcattggtggaatgccctcagataaccattcctcttaattaactgtgtgctgctctgtcctgacctccctacttccgctgtcttggaggatatgtcatccttcttgagaaaggcaaatacttccatctatgtttatggagcctctgtcttctgactttatcacatccttttccttcagttatatcccctcccgcagcccccacctacatttaacctcttctagtccttctcttgtggaaagacatttttcaggtctctttgatctaaaaagcaaactctgccttagccaaagcttctctgtgatctgtacctttcattttctgcacagttgaacttcttcatagtctatacttgctgcctccccttcctcacttcatgcaaacaggtggaaagctgttttagtcattcatttattagatagttgaatgctacccatatataagtgtcaagtacatggtagtgattaaaacagtctctgcttttctgaattttttttttttttttgaggcagtctcactgtttcacctaggctggagtgcagtggcacaatcttggctcactgcaaccttcacctctcaggtacaagtgattcttttttttttttttttttttttttgagacaaagtctcactctgttgccgaagctggagtacactggcacgatctcagcttactataacctccacctcctgggttcaagcgattctcctgcctcagcctcctgagtagctgggactacaggcacgcatcaccatgcccagctaatttttgtatttttagtagagacagggtttcactatgttggccaggcttgtcttgaactcctaaccttgtgatctgcctgcctcagcctcccaaagtgctgggattacaggcgtgagctgctgcgcccggccaggtacaagcaattcttgttcctcagcctcccaggtagctgggactacaggtatgcaccaccatgactggctaatttttgtatttttagtagatacgaggtttcaccatgttggccaggctagtctcgaactcctagcctcaagtgatctgccctcctcagccccacaaagtgctgggattatatatgaagtgcttcagaggtgttacagaaaggacccacttggattgtggctagggatgagggtaggtttgcctgagatgacattataagcagaaatctgaaagctctaaggaacagaataaggcatttgagacatcagaaaagaatgatgtgtgtttaaggctctaaggtgtaaagcaccttgttcctagcagttgagaggaggcggtgttggctagaatgttggggttagagcgtgagtagaaataagattgtgcaggtcttgtagactgtggtaaggagtttgagttttaagtgaaatgggaagttgttgaagggttttaagccagagagtgaagttccctgattgacatttgtgaaagatgttctctggttacatggagagtggactggagaggagcagcagaagtggtaggaggctacttgtagtctatccagacaggagatgagtgtgctctgggctaagggcatgtttgtggagatgaggaaaagtgagtgaacttgaaacttcacatttctttcttgaatggactttttagttcattttaaaaatagctgtgggagagtgaaagggaagaggaaaagggaaggaccagaccagggaggactcctggctttctagctggagcaactgtttgatagtttcatttgctgaagtgttcaagattagggaagggaatggattttagagggaaaatctagaaattacatttgagttttagacttttaacgtttgagagtcctgtgagatacccaagtagaaactcaaagaggaatttttatttttaattttttaaatgttttaaatttaaaatgtttgttttttgagatagcgtcttgctgtttcagccaggctggagtgcagtggcctgatcatagctcactacagccttgagccttgacctactgggctcaagccctcctgtcttagcctcctgagtagttggaaccacagatgaacaccaccatgcttggctaatttttttttttttttttttttttaagagatgtggtttccctgtgttgcctgggctggtttcaaactcctgatctctagcaatggctcctgcgacaacctcacaaagtgctgggattataggcgtgacccactgtgcctggctgatatttttatatatctggaaatttgagaagtatgagtgagagatgcatattgcaagtttataaaatgtaaatagtatttgaaatcagaagattggatgagatcactgacagaatacaggaaaaagaggaggagacctagaaattagccctaaggagctcctgtatttaatggtcgagtgaaggagaaagtgctagaaaagaagctgagaaaggatcctcagaagtaggaggaaacttaggtgcatggtttcactatcactttctcaagaaggatggagtggtcttctaaagagaatgttgcagagaaggtaaattaaggatagaagagtgccccattggtcttaaacatggagatcttgtcagggggcagatgacaaaaattggaatatctgttagacaaaaggtcagaatatacaatccccagaaaatacatgggaacataaatgtaggaaaatgttcatcattcctgatagtcaaagaaatgtatgctataattttgatgttaattttcatttataaaattagcaaaggcttaaaaaaatgagcacaaccagaactgacaatggggatataaaacaggtacaataaaaattattggtgagaatattaattggtaccattacttaagcaacaaaatatttaaaatagagacctttttgcgtcggagtcatctagtctgaattctgagatttggttaaaatatgtactctgtaatcttatttgtttagtgagctttctttaatactagtttgaaacttcctctctcatcagtcttaaggtttgtgttttactctgagcaattagtatttcccatgaagtacgtttttccctttgttcaggatgacagcaaaaacagttatgtttatattgtttctatttctgggaagtagattttttgaattagaataatttttatacttttgatttacaagactacaaatgcatatttaacataagtttgtttcggcttactaattttaggtctgcctgtgttttacacaaaaaattttttttatgcttcagatggcaagattattttatcataaaccccagtttgccattttggatgaatgcacaagtgcagttagtgtcgacgtggaaggctacatttatagtcattgtcgaaaggtaagtacgcaggtgctcagtttgaggagccatggcctcctacctagtgtaaactatgtccaaatctgtccaaagagaagattccaggtcactaagtaacaaaatttctaccaaaagatttcttgttttaataaagatttaaaacatatgaataaaagaaaaagaattataaatacagttctgtatataattctctttatatatgggaaatagatttaaatatgttgttttatataagtgagatataaaagatatatataaatgagatacaaaagatatctcatttatatataaatgagttacaaaagtttttaacttttatgttaaaagatttatttatttattttttaatttattattattatactttaagttttagggtacatgtgcaaaatgtgcaggttagttacatatgtatacatgtgccatgctggtgcgctgcacccactaactcatcatctagcattaggtatatctcccaatgctatccctccccccttcccccaccccacaacagtccccagagtgtgatgttccccttcctgtgtccatgtgttctcattgttcaattcccacctatgagtgagaatatgcggtgtttagttttttgttcttgcgaaagtttactgagaatgatgatttccaatttcatccatgtccctacaaaggacatgaactcatcattttttatggctgcatagtattccatggtgtatatgtgccacattttcttaatccagtctatctttgttggacatttgggttggttccaagtctttgctattgtgaataatgccgcagtaaacatacgtgtgcatgtgtctttatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctgtttctccacatcttctccagcacctgttgtttcctgactttttaatgattgccattctaactggtgtgagatgttatctcactgtggttttgatttgcatttctctgatggccagtgatggtgagcattgtttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttctcctagggtttttatggttttaggtctaacgtttaagtctttaatccatcttgaattgatttttgtataagatgtaaggaagggatccagttttagctttctacatatggctagccagttttcccagcaccatttattaaatagggaatgctttccccattgcttgtttttctcaggtttgtcaaagattagatagttgtagatatgcggcgttatttctgagggctctgttctgttccattgatctatatctctgttttggtaacagtaccatgctgttttggttactgtagccttgtagtatggtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcgtgatttggctgtttgttgttggtgtataagaatgcttgtgatttttgtacattgatttttgtatcctgagactttgctgaagttgcttatcagcttaaggaaattttgggctgagacaatggggttttctagatatacaatcatgtcatctgcaaacagggacaatttgacttcctcttttcctaattgaataccctttatttccttgtcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagataggtcccatcaatacctaatttattgagagtttttaccatgaatggttgttgaattttgtcaaaggccttttctgcatctattgagataatcatgtggtttttgtctttggttctgtttatatgctggattacatttattgatttgcgtatattgaaccagcctttgcatcccagggatgaagcccagttgatcatggtggataagctttttgatgtggtgctggattcggtttgcgagtattttattgaggatttttgcatcaatgttcatcaaggatattggtctaaaattctctttttttggttgtgtctctgcctggctttggtatcaggatgatgctggcctcatgaaatgagttagggaggatcccctctttttctattgactggaatagtttccgaaggaatggtaccagttcctccttgtacctctggtagaattcggctgtgactccatctggtcctggactctttttggttggtaagctattgattattgccacaatttcagctcctgttattggtctattcagagattcaacttcttcctggtttagtcttgggagtgtgtatgtgtcgaggaatttatccatttcttctagattttctagtttatttgcgtagaggtgtttgtagtattctccgatggtagtttgtatttttgtgggatcggtggtgataatcccctttatcattttttattgtgtctatttgattcatctctctttttttctttattagtcttgctagcagtctatcaattttgttgatcctttcaaaaaaccagctcctggattcattaattttttgaagggctttttatgtctctatttccttcagttctgctctgattttagttatttcttgccttctgctagcttttgaatgtgttttctcttgcttttctagttcttttaattgtgatgttagggtgtcaattttggatctttcctgctttctcctgtgggcatttagtgctataaatttccctctacacactgctttgaatgcgtcccagagattctggtatgttgtgtctttgttctccttggtttcaaagaacatctttatttctgccttcatttcgttatgtacccattagtcattcaggagcaggttgttcagtttccatgtagttgagtggttttgagtgagtttcttaatcctgagttctagtttgattgcactgtggtctgagagatagtttgttataatttctgttcttttacatttgctgaggagagttttacttccaagtatgtggtcaattttggaataggtgtggtgtggtgctgaaaaaaatgtgtattctgttgatttggggtggagagttctgtagatgtctattaggtctgcttggtgcagagctgagttcaattcctgggtatctttgttgactttctgtcttgttgatctgactaatgttgacagtggggtgttaaagtctcccattattaatgtgtgggagtctaagtctctttgtaggtcgctcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggatcacaacccctgccttttttttgttttccatttgcttggtagatcttcctccatccttttattttgagcctatgtgtgtctctgcacgtgagatgggtttcctgaatacagcacactgatgggtcttgactccttatccaatttgccagtctgtgtcttttaattggagcatttagtccatttacatttaaagttaataatgttatgtgtgaatttgatcctgtcattatgatgttagctggttattttgctcgttagttcatgcagtttcttcctagtctcgatggtctttacattttggcatgattttgcagcggctggtaccagttgttcctttccatgtttagtgcttccttcaggagctcttttagggcaggcccggtggtgacaaaatctctcagcatttgcttgtctgtaaagtattttatttctcctttacttatgaagcttagtttggctggatatgaaattctgggttgaaaattcttttctttaagaatgttgaatattgtcccccactctcttctggcttgtagggtttctgccgagagatccgctgttagtctaatcggcttccctttgtgggtaacccgacctttctctctggctgcccttaatattttttccttcatttcaactttggtgaatctgacaattatgtgtcttggagttgctcttctcgaggagtatctttgtggtgttctctgtatttcctgaatctgaacgttggcctgccttgctagactggggaagttctcctggataatatcctgcagagtgttttccaacttggttccattctccccgtcactttcaggtacaccaatcagatgtagatttggtcttttcacatagtcccatatttcttggaggctttgctcgtttctgtttgttcttttttctctaaacttcccttctcgcttcatttcattcacttcatcttccatcactgataccctttcttccagttgatcacatcggctcctgaggcttctgcattcttcacatagttcttgagccttggttttcagctccatcagctcctttaagcacttctctgtattggttattctagttatacattcttctaaacttttttcaaagttttcagcttctttgcctttggtttgaatttcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttggtgaccgtgatgtacagatgggtttttggtgtggatgtcctttctgtttgttagttttccttctgacagacaggaccctcactactgatttcttctcttctttcctccctttttcctttttttccttcctaaatgatatagaaattttaggtagtcatgtaaaagatatctcattgatatataaatgagatataaaagatacctcatttatgtaaaacaacatatttaaatctctttataattctctttatatatgggaaatatatttaaatatgttgttttatataaatgagatataaaagataaaagatataaaagatacctcatttatataaaacaacatatttaaatctatttcactttacctcattacttagagttaataaactgaccttttcttaatttttccattaactttatctaaacattagagtttttttatgaataaaactcaacaataattatttggcaatttttaatttatccgttttattttctagcctgagcaatattttaccaaagctgcttttagtagctaagtctgaggctatctttattggttccattctttaagtaattattcaatagtatcagttttctttctttgagaaattgttaccaacatctatactatggttaaattttggaacaaatgtagtatatcctagctgttttatagtttctatataagtaaatgaggtagatgaggatttttaacattttgtatgtgttctttgggagttctcaataaataaaaaaggtcatattgagtatatatattatgaattcctactattccaagtgtgttcatgatcagcagcagcagtgtcacctaggggtttgttagaaatgcagaatttcaagccctgctaaatcagaatctgcattttaccaaaattctaagatgattcaaatgcgcattaaagtttgagaagcactggcgtgatgatgaaagaatttgctattctttgtagaaagattttaactactgattttatcttgttaatgatttattttctattcttgaatttgctttggtaatatataattatacatttgttcatgttggttttcaaatatataggtattagagatgtttatggtattctcatgtacataaaaccatgtagtctgcagttgattcaatgacatagcagctctttgctggtaattttgaccacgtgatttcctcttatgctctagctataggcttgaagtccccacataagactgtataaattctataaaacatcagttccatttaaaagaaaattcatatggggcctcattgataatttaaattactgtgataccacttaaacatgtataaacatgatgaggtgtgaattccttaagcttagagctcttttacagctacaaaactaatataaacttacacattaaatacattaaatacagacaaaacttaaatacagtttcaaatttacaacattaaagagacctatgataccgtttagatgaaactaaaccagtggtttgggatttaattaaggaaagatagaatctgaggttcaaatttcattattttgcattttgctttttattttgacttatatacttcatatattttttatatcctcatgtaaagaatgtgtgcattaagtagatgtctaatccaattattgtagtatcataaacagagaaataatatcttaaatgagctctgaaaaatcagaaaagtgtggtatggttgaaatatatgttttattaatactgataatatgcttattttattatgcaattcctaaccaatttaagaacctttttacagtgcagccaaacttattacacattagaagttttattttatatcactttggcaatcagaggtgtagatacaaaccgaggaacttgaatctcatggtaaaaatgatctagaatatacttataatgatcttttaaaaattatcatcaaaatgaaaataaaattaagaaaccatggtggaaatttcccagatgccctaagcatgcatttgccagccttgagtgatccacttggaggaacagtgacccagagtggggtttctcagtcctggcactattgaccttttcactgttaattcctagttgggcagggttgagggttgctgtgcactggaggatgtttagaaagcatccctggcctctgcccattagatggcagtagtgctttcagttgtgaaaataaaaatgcctccagtcattgccaaatgtccccctgagggacaaatatcactgacctccccaccttggttgagaaccactgatctagagcaactacagctattatctattaatgtttttttttttttgaaaatctgaagtacagatctataaatacgtattcacaatctgaaatccagaaagtgcttaaatttaaaacatttttcataattttgtagcaagctcactgggtaaaacttcgcctaagctaacaaaagatatttaaactctatatgtctcaatatcagtgtccatgtgtgttgctacagaaacatttatgtgtttaattataaaattctgcctcagaactctctgggggtgttaaataatacattttcaaaatctgaattccaagacacattccaaaacagtagtttacggtaggggattatgaccctgtatttgaaaagcaagttgactgtcaacaatgctatactgatttaatttttcctgattttgacctttggctatttttatccttctcatattcctctcatatatttttcacaataaaataggagacatgataggagatatgttttttgcccaaaagaaaataatacacttaatgccagtacctggtagtttttattatgtggttgatggccagtactttccattgctataaacattttgcatccagttgtaaattttttctcattgacattgctttttaactttagtcactgaagactgtcctcttaacagcttaaagtacatggactagtttaatttgtgactctgttactgattaaacctaaatcattttctttgtattaggttggcatcactctcttcactgtgtctcataggaaatctctttggaaacatcatgaggtttgtatttctttcattgaatggtacagtgaaattttattttctttaaaatatgaattcaggttaatatggttttagattttatggtttgtattcccttaaacatatgtcttaaggagaaaaggtggttttgttttataaaataggattttcttaaatattatagttgtcagttttgaaagcaatggtgtaacagtttttctccagttttataagtgactcttatctgttaatagtaactgactaaactttgcatagtcttatcacaaatatggtgaagtaaacttttcttatccagcagtgacagaggagaaaaagtcttaagaagaattagatggcaaaaaatttagggacatttttaatagaggtcaggactacaagggggaagattgaataacataagctatgtttatcaatgtactgtagtaagtaggattcattagatagtcactataatttacaaagatattcaaatgaggcttacattggtgcacatgtattacttattctggtgcttcagtagtgccattctcactatgtcagttcttttcaactcaatgtgaaatgctcaaaacctgaaagtaaacccagtttaattctctttattttcttttactcctccctccctccctcccttcctttcttccttcctttcttttcttctttcctttctgtctttcccccttccctctttcctttcttctcttctttccttcttttccttcctaaatgatatagaaattttaggtaaaagcaaggatttgagaaaaattggataatggtaaaggtgccttgttccacaaatacatacctgattaaggaccttnttttgccagatactgagctaagtgtcatgagggatgcaattaattacagtttttaccttcaagaactttaggatgtagatgatagtctacaagtgataaaatgaagagcataggatttgaagtcagagagcctgggttcaggcaccaaagtttctagcctcagttgcttcctttgtataatgaagttattgagccttaccttcctatctcttagattaccatgaaaattagacaggtagcctatatgaaagtacttaataaaattcagtgaaattctatataactgtgtgacttttaaagatagcttttattattttatggcatattataacttgtcaatttttcatgaactgagcaggaaattgaataactagaaatcaaaggcatttaaaatatagccaagcctttatgttttctcggaagttcataagtattatagccataggacattgagaggaattgagagcatttgggtttcacccttcctcttcttttggaggtatagacaagtagcaaaataatcatcacgccagtgatcatgtgaaggaggggaacacaactagaatgtgaggggccaggatagctaagaaatagtaatacagaaaatggaaactcagaaagctttctgaaaataagccactaaataaaaacagaaggctttgtaactgctgttgtgtcttcagaggttaggatatatcggcagtttttatagctctttttcccctctactaaattaaaaacaaataaaaagccttaagctggagatttcaagctgattaggaaatcaggctacaggaaacaatactgactgacctatggaacagtcttgcatttagcacagtttaacctactggtagctgagatccttggtcatggagttacggaagcattctgatttgtgggatgcttatagatttagctcccttaaaataatgaggaagtctgtattttacttttcataaaagacagtactatattcactcttagttactgactttttttcccccttctttcccatagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagtttttttttaaaaaaaaaacaaagcaacaaattgactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggtagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttagcacagtgtctcttttttaaagttttgccaagtgtggtttttaattgaatgaatttctcttttagaaaagttcagtaaaatctgtgtacctgacaaatgctaccaaacagccaggagaccttaaaagatactattcgtcttggaaaagattttaaggcatgggaaagtttcagattttcagatttctgggttaccttaaacctactcgtagaagtattctcctagctgccttataattgcttttgttatgattcttgccatcaaaacaacaacaacaacaatttgggctttttttcttaattattttcttttttatgtaacaaatattacagtgcctcaccatttgaggcacagaggaagatccttctggagaatcacattaacataatagtggttcttcgaagacccacagtaaagaaatccattggttcaaaaacatgattgaccacggaacatctttttctacataattcctattaacaccttccagaaactgcagtgggaaatggtagtttaatccgaagaataaaccaaagaataagaactttcatccatgagcaccacgctgcatgccaagacatatcaccgtgttctcataataagtttttactttttatataatgagaaaataagtatgaaacagcaatggtagtttgttt

SEQ ID NO: 12659 - DNA, 15085 bp, Homo sapiens
tttttttttttattctttttttaatttattatactttaagttccagggtacatgtgcacaacgtgccagtgtgttaaatatgtatacatgtgccatgttggtgtgctgcacccattaactcatcatttacattaagtatatctcctaatgctatccttcccccctccccccaccccacaactggccctggtgtgtggtgttccccaacctgtgtccaagtgttctcattgttcatttcctacctacgaatgagaacacacggtgtttggttttctgtccttgcaatagtttgctcagaatgttggtttccaacttcatccatgtccctacaaaggacatgagctcatccattattatggctgcatagtattccatggtgtatatgtgccacattttcttaatccagtctatcattgatggacattttggttggttccaagtctttgctattgtgaatagtgccacaataaacatacgtgtgcatgtgtctttatagcagcatgatttataatcctttgggtatatacccagtaatgggatggctgtgtcaaatgggatttctagttctagacccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggcatctcattgtcgttttgatttgcatttctctgatggccagtgatgatgaacattttttcgtgtgtctgttggctgcataaatgtcttcttttgagaagtgtctgttcatatccttcgcccacttgttgatggggttgtttgattttttcttgtaaatttgtttaagttcttagtagattgtggatattagccctttgtcagatgggtagattgcaaaaattttctcccattctgtaggttgcatgttcactctgatggtagtttctttcgctgtgcagaagctctttagattatttagatcccatttgtcaattttggcttttgttgccattgcttttggtgttttagacatgaagtccttgcccatgcctatgtcctgaatggtattgcctaggtttccctctagggtttttatggttttaggtctgacatttaagtctttaatccatcttgaattaatttttgtataagatgtaaggaagggatccagtttcagctttctacatatggctagccagttttccaagcaccatttattaaatagggagtactttccccatttcttgtttttgtcaggtttgtcaaagatcagattgttgtagatgcgtggtattatttttgagggctctgttctgttccattggtctatatctatgttttggtaccagtaccatgctgttttggttactgtagccttgtagtatagtttgaagtcaggtagtgtgatgcctccagctttgttcttttggcttaggattgtcttggcaatacaggctcttttatggttccaaatgaaccataaaagtagttttttccaattctatgaagaaagtcattggtagcttaatggggatggcattgaatctgtaaattaccttgggcagtatggccattttcacgatattgattcttcctatccatgagcatggaatgttcttccatttgtttgcatcctcttttatttcgttgagcagtgatttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggcagagatgatggggttttctagatatacaattcatgtcatctgcaaacagggacaatttgacttcctcttttcctaattgaataccctttatttccttctcctgcctcattgccctggccagaacttccaacactatgttgaataggagtggtgagagaaggcatccatgtcttttgccagttttcaaagggaatgcttccagtttttgcccattcagtatgatattggctgtgggtttgtcataggtagctcttattattttgagatacgtcccatcaatacctaatttattgagagtttttagcatgaatggttttcgaattttgttgaaggccttttctgcatctattgagataatcatgtggtttttgtctttggtactgttgatatgatggattacgtttattgatttgcgtatgttgaaccagccttgcatcccagggatgaagcccacttgatcatggtggataagctctttgatgtgatcctggattcagtttgccagtattttattgaggatttttgcatcgatgttcatcagggatattggtctaaaattctctttttttgttgtgtctctgccaggctttggtatcaggatgatgctggcctcataaaatgagttagggaagattccctctttttctattgattgcaatagtttcaaaggaatggtaccagctcctccttgtacctctggtagaattcggctgtgaatccgtctggtgctggactttttttggttggtaggcttttaattattgcctcaatttcagagcctgttattggtctattcacggattcaacttcttcctggttaagtcttgggagggtgtatgtgtccaggaatttatccatttcttctagattttctagtttatttgcatagagttgtttatagtattctctgatggtagtttgtatctctgtgggatcggtggtgatatcccctttatcattttttattgcgtctatttgattcttctctcttttcttctttattagtcttgctagcggtctatcaattttgttgatcttttcaaaaaaccagctcctggattcattgattttttgaagggtttttgtgtctctatctccttcagttctgctctgatcttagttatttcttgccttctgctagcttttgaatgtgtttgcccttgcttgtctagttcttttaattgtgatgttagggtgtcaattttagatctttcctgctttcccttgtgggcatttagtgctataaatttccctctacacactgctttaaatgtgtcccagagagtctggtatgttgtgtctttgttctcattggtttcgaagaacatctttatttctgccttcattttgttatgtacccagtagtcattcaggagcaggtttttcagtttccatgtagttgtgctgttttgagtgagttcttaatcctgagttctagtttgattgcactgtggtctgagagacggtttgttgtgatttctgttcttttacatttgctgaggagtgctttacttccaactatgtggtcaattttggaatacgtgtgatgtggtgctgagaagaatgtatattctgttgatttggggtggagagttctgtagatgtctattaggtccacttggtgcagagctgagttcaattcctggatatccttgttaactttctgtctcgtggaactgtctaatgttgacagtggggtattaaagtctcccattattattgtgtgggaatctaagtttctttgtaggtctctaaggacttactttatgaatctggctgctcctgtattgggtgcatatgtatttaggatagttagctcttcttgttgaattgatccctttaccattatataatggccttctttgtctcttttgatctttgctggtttaaagtctgttttatcagagactaggattgcaacccctgcctttttttgttttccatttttttgttagatcttactccatccttttattttgagcctctgtgtgtctctgcacgtgagatgggtctcctgcatacagcacactggtgggtcttgactatccaatttgccagtctgtgtcttttaattggagcatttagcccatttacatttaaggttaatattgttatgtgtgaatttgatcctctcgatatgatgttacctggttatctgttcattagttgatgcagtttcttcctggcattgatggactttacaatttggcatgtttttgcagtggctggtaccggttgttcctttccatgtttagtgcttccttcaggagctcttgaaagacaggcctggtggtgacaaaatctctcagaatttgcttctctgtaaaggattttatgtctccttcacttatgaagcttagtttagctggatatgaaatcctgggttgaaaattcttttctttaagaatgttgaatattggcccccactctcttctggcttgtagatagagtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccaacttggttccattctccctgtcactttcaggtacaccaatcagacgtagatttggtcttttcacatagtcccatatttcttggaggctttgttcatttctttttactcttttttctctaaacttctcttcttgcttcatttcattcatttgatcttcaatcactgataccctttcttccacttgatcgaatcagctactgaagcttgtgcgtgcatcacatagttcttgtgccatgattttcagctccatcaggtcatttaaggacttctctacactgttttttctagttagtcattcatccaatcttttttcaaggtttttagcttgtttgtgatgggttcgaacatcctcctttaacttggagaagcttgttattactgatcatctgaagccttcttctctcaactcgtcaattcattctctgtccagctttgttccattgctggtgaggagctgcattcctttggaggagaagagtcgctctgatttttaaaattttcagctattctgctctggtttccccccatctttgtggttttatctacctttggtgtttgatgatggtgatgtacagatgaggttttggtgtggatgtcctttctgtttgttagttttccttctaacagtcaggaccctcagctgcaggtctgttggagtttgctggaggtccactccagaccctgtttgcctgggtatcaccaggagaggctgtagaactgcagatactgcagaacagcaaatgttgctgcctgatcgtttctctgaaagcttcatctcagaggggcacccagctgtatgagttgtcagttggcccctactgggcggtgcctcccagttaggcttctcgggggtcagggacccacttgaggaggcagtctgtccattctcagatctcagactccatgctggcagaaccactactctcttcaaagctgtcagacagggatgtttaagtctgcagaagtttctgctgccttttgttgagctatgccctgcccccagaagtggaatctacagaggcaggcaggcctccttgagctgtggtgggctccacccaattcgagctttccagccgctttgtttacctactcaagcttcagcaatagcaggcgcccatcccccagcctcactgctgccttgccattcaatctcagactgctgtgctagcagtgagcaaagctccgtgggcgtgggaccctcccagccatgcatgggatataatctcctggtgtgccatttgctaagactgttggaaaagcacagtattagggtgggagtgacccgattttccaggtgccgtctgtcacggcttcccttggctaggaaagggaattatctgacccctcgcgcttcccaggtgaggcggtgccccaccctgtttcggctcccggtccgtggcctgcacccactgtcctgcacccactgtctgacaagccccagtgagatgaacctggtacctcagttggaaatgcagaaatcacctgtcttctgcatcactcatgctgggagctatagactggaggtgttcctatttggccatcttggaaactccccctaaacctcttttctttataaattacccagtctctcaggtagttcttcatagaaatgtgagatcagactaatatagtgtctttgctgtatttggggtgttaggactctccgttctgtttgactatttttccatacttaggtcaacaacacattgtcttgactactgaagtttgaaatcgggtagcaaaggttatctagctttgctattgtttttcaagattattttgcctttccacatgctttgtatttttacataaatgttagaactagcttgtcaatttagaattagcttatcaaggaagtttgctgatattttgactgggatttcattgaatataaagatcaatctgtggcgagattaattcttaagagtattgaatctatccactgacttaagaaaagcttttgatgaaaatataatttcttttaatatttgtcagtgagataaggttgaacataattaagattttcattaacttcaacaagtcatgtcactagtttataatgtgtgcttcattatagcagtgtctaagctttggtgaatattatattcctgaatcctagtctggctttcttaactccctagaagatgtgccagaaccacagtgctaaccttttcccaataaaattgtttttaggagctcttgaaacaacatcaaagtgacaccttgcaattagaagagctgagaaaaaccaaagaggtaagctttttcatcctttcctgtggacttggtatattacaaatacaccaataaaataacaagctgtcagtataatggaatcaatgataatttccccaaagccaataagaaatggaagacctaaagctgagtttactggattcaataagttaaaaagaatttttgaaattatctgtaaaataaagccagtgggtctttttaaagtctgatttgaacaaatagatcagcaatatactatgtgatcttcaatgttgaatgactttcatttctagcaaggttcaaaccacaaatgatctttcagttataaaacaccaagttcttccctttgagctctgaaaagtataaaactgtctcctttgaaactctgtcaccaagcccctccttaagctctgaatgtacctcacacatgataacttcctcagggactctattctggggcaaattatggcagtctgtgggagacaactgaagaggagccgttcaaatccacaaggtgatgtgtgattcttccatcactgaaaatttgacttggatccagaatggacacgtttgagaaaacattagtcattataaaggcattgtaaatgaattctatcttagagcccaggcagggcttcagcattatggaaaggcaaacagactgtggtgtcctacaagttcaagaaatgggctttggaggaagatatacccagtgtattataataactattttcatgagcttgtctacgaattctgtcatttgtgtcatgtctgggcctgtttctcttcattgatttttctcctcatttatggtcatatttccttgtttgcatgcctggtaagtttggcttggatgtcagtcattttggtgtttaccttgttgggtgctgaatatttttatattcctttagatattcttaagctttgccctgggatgcagttaagttgcctggaaacagtttgatcctttcaagccttgctttttaagcttcgttgggcagaactaaagcagtctttagtgtggaactaattttccccactattgaggtaataccctctgagtacttgacaccacaccctctgtatgagaaggattttctactctgcctggtgggaccatgaactattcccagccttgtgttggccctggggattgttccacctgctccttgctgatgtttccttcctctaaccttgtctctttctatttcttccctacatcactccaccccagaggcacttgcctccttgctgttcccttaacaggccaggatgttcctacctgggggtctttgatgttctctcttcctgaaaagctctttcccggatatccacatgactaacttcctttcctcctcctgttctttattcaaatgccaccttctcagaaggtgcccgatttaagggctccgctccctgcccaacacttgcttttctccaaatgggatgccactggaggtttttgaggagagagtatcatttgggaaaataactgtggcagcaatgtgaaggagaatctgaagaggcaaaatgatgggaggcagaacctattagaagggtcacctcccctttacacctcaacctgacttctgctccaatcccagccatggaaactgttcttgttaaaatcacaagtaaattccgagttgccaaatccaaggaatgcttcacctcactggacatgagcagtatcaggtgcgattgatcattctctccttgcaacattcacctgtcttagctttcatgggcttctggtgtttccttcacctcattggtcacaccttctcaatctcctttactagaactagaactctgcttaaaacccttcaatggcaccccactgttctcccacctactttctaagtcctggagtattttgaggcttgttcccaggccccacttatcttctttatctcccgtttctcctttggtgagctcatctgttcacacagatgtaaaagccatctctgtactgataacttggtttgatacctccagccttgcctctctcctgagctccaggcttgtacatccaactgcccatttgacatttcaacataggtgacatacagacacctcaaaattaacatgcccagttccacactctcaattttccaccagagatttagcccccaaattgtcaactccctcagctgttctaagcctagacctgaagtcatccttgatttcttctttcctttcactctcccaaattcaacccagcagcctcagccaatcctctataacataatccaaattcatccacgtccctccaactctgttgtcaccttaccctagtccattatttctcacctacacgactgtagtattctcctccttagttccgttgctttccctcttgcccttccaatccatccccatggagcataatgtaaacagtaagatacgtgcattcacttctctgcttaaaacccttcagtaggtccccattgttcttaggttaccttgtcctctcaggtgccaccagacttccctgtatttcctcaccatggccctctatccttactatctctattccagccatattggtgttcctttgggtcctcaaacagaatgagaattttgcattttttttattatactgtaagttttagggtacatgtgcataatgtacaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccatgtgttctcattgttcaattcccacctctgagcaagaacatgtggtgtttggttttttgtccttgccatagtttgctcagaatgatggtttccagcttcatccatgtccctaccaaggacatgagctcatcattttttatggctgcatagtattccatggtatatatgtgccacattttcttaatccagtctatcattgttcgacatttgggttggttccaagtctttgctattgtgagtagtgccgcaataaacatacgtgtgcatgtgtctttatagcagcatgatttataatcctttgggtatatacccagtaatgggatggctgggccaaatgggatttctagttctagatccctgaggaatcgccacactgacttccacaatggttgaactagtttacagtcccaccaacagtgtaaaagtgttcctgtttctccacatcctctccagcacctgttgtttcctgactttttaatgatcgccattctaactggtgtgagatggtatctcattgtggtttgatttgcatttctctgatggccagtgatgatgaacattttttcatgtgtcttttggctgcataaatgtcttcttttgagaagtgtctgttcatatcctttgcccacttgttcatggggttgtttgtttttttcttgtaaatttgtttgagttcattgtagattctggaatattaaccctttgtcagatgagtaggttgcaaaaattttctctcattctgtaggttgcttgttcactctgatggtagtttcttttgctgtgcaaaagctctttagtttaattagatcccatttgccaatttaggcttttgttgccattgcttttggtgttttagacatgaagtccttgcccatgcctatgtcctgaatggtattgcctagattttcttctagggtttttatggttttaggtctaacatttaagtctttaatccatcttgaattaatttttgtataaggtgtaaggaagggatccagtttcagctttctacatatgactagccagttttccaagcaccatttattaaataaggaatcctttccccatttcttgtttttgtcagatttgtcaaagatcagatagtgtagatatatggcattatttctgagggctctgttctgttccattggtctatatctctgttttggtaccagtaccatgctgttttggttactgtagacttgtagtatagtttgaagtcaggtagcgagatgcctccagctttgttctttggcttaggattgacttggcaatgcgggctcttttttggttccagatgaactttaaagtagttttttccaattctgtgaagaaaatcattggtagcttgatggggatggcattgaatctataaattaccttgagcattatggccattttcacgatgttgattcttcctatccatgagcatggaatgttcttccatttgtttgtatcctcttttatttcgttgagcagtggtcaacgaagaggtccttcacatcccttgtgagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggcagagatgatggggttttctagatatacaatcatgtcatctgcaaacagggacaatttgacttcctcttttcctaattgaataccctttatttccttctcctgcctcattgccctggccagaacttccaacactatgttgaatgggagtggtgagagagggcatccctgtcttttgccagttttcaaagggaatgcttccagtttttgcccattcagtatgatattggctgtgggtttgtcatagatagctcttattattttgagattcgtcccaccaatacctaatttattgagagtttttagcatgaacggttttcgaattttgttgaaggccttttctgcatctattgagataatcatgtggtttttgtcattggttcggtttatatgctggattacatttattgatttgcgtatgttgaaccagccttgcatcccagggatgaagcccacttgatcatggtggataagctttttgatgtgctgctatatttggtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgattgcaatagtttcaaaggaatggtaccagctcctccttgtacctctggtagaattcggctgtgaatccatctggtcctggactttttttggttagtaagctattaattattgcctcaatttcagagcctgttattggtctattcagggattcaacttcttcctggtttagtcttgggagtgtgtatgtgtccaggaatttatccatttcttctagattttctagtttatttgcatagaggtgtttatagtactctctgatggtagtttgtagttctgtgggatcggtggtgatatcccctttatcgtttttttttgcgtctatttgattcttctctcttttcttctttattagtcttgctagcattctattaattttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgccataaatttcccctacacactgctttaaatgtgtcccagagattctggtatgttgtgtctttgttctcattggttttgaagaacatctttatttctgccttcatttcattatgtacccagtagtcattcaggagcaggttgttcagtttccatgtagttgtgtggttttgagtgagtttcttaatcttgagttctagtttgattgcactgtggtctgagagacggtttgttgtgatttctgttcttttacatttgctgaggagtgctttacttccaactatgtggtcaattttggaatatgtgcgatgtggtgctgagaagaatgtatattctgttcatttggggtggagagttctgtagatgtctattaggtctgcttggtgcagagctgagttcaattcctggatatccttgttaactttctgtctcgtggagctgtctaatgttgacagtggggtgttaaagtctcccattattattgtgtgggagtctaagtctttttgtaggtctctaaggacttactttatgaatctggctgctcctgtattgggtgcatatatatttaggatagttagctcttcttgttgaattaatccctttaccattatataatggccttctttgtctcttttgatctttgttaattgaaagtctgttttatcagagactagtattgcaacccctgcctttttttgttttccatttgcttggtagatcttcctccatccctttattttgagcctctgtgtgtctctgcatgtaaggtgggtttcctgaatacagcacactgatgggtcttgactatccaatttgccagtctgtgtcttttaattggagcatttagcccatttacatttaaggttaatattgttatgtgtgaatttgatcctgtcattctgatgttagctggttattttgctcgttagttgatgcagtttcttcctagcctcgatggtctttacaatttgacatgtttttgcagtggctggtaccggttgttcctttccatgtttagtgtttccttcaggagctcttttaaggcaggcctggtgtgaccaaatctctcagcatttgcttgtctgtaaagtattttatttctccttcaatcatgaagcttagtttgactggatatgaaattctgggttgaaaattcttttctttaagaatgttgaatattggccctcactctcttctggcttgtagagtttctgctgacagatctgctgttagtctgatgggcttccctttgtgggtaacccgagctttctctctggctgcccttaacattttttccttcatttcaattttggtgaatctgacagttatgtgtcttggagttgctcttctcgaggagtatctttatgctgttctctgtatttcctgaatctgattgttggcctgccttgctcggttggggaagttctcctggataatatcctgcagagtgttttccaacttggttccattctccctgtcactttcaggtacaccaatcagacgtagatttggtcttttcacatagtcccatatttcttggaggctttgttcatttcttcttattcttttttttctaaacttctcttcttgcttcatttcattcatttgatcttccatcactgataccctttcttccagttgatcgaatcggctactgaggcttgtgcatttgtcacatacttcttgtgccatggttttcagctccatcaggtcctttaaggacttctctgcattggttattctagttagccattcgtctaatcttttttcaaggtttttaacttcttggccatgagttcgaactttctcctttagctcggagtagtttgatcatctgaagccttcttctctcaactcgtcaaagtcattctccatccagctttgttctgttgctggcgaggagctgcattcctttggaggaggagaggcactctgatttttagaattttcagtttttctgctctgttttttccccatctttgtggttttatctacctttggtctttgatgacagtgacgtacagatggggttttggtgtggatatcctttctgtttgttagttttccttctaacagtcaggaccctcagctgcaggtctgttggagtttgctggaggtccactctagaccctgtttgcctgggtatcagcagcggaggctgcagaacagcagatattggtgaacagcaaatgttgctgtctgattgttcctctgaaagttttgtctcagaggagtacccagccgtgtgatgtgtcagtctgcccctactggggggtgcctcccagttaggctactcaggggtcagggacccacttgaggaggcagtctgtccattctcagatctcaagctgcgtgctgggagaaccattactctcttcaagctgtcagacagggacatttaagtctgcagaggtttctgctgccttttgtttggttatgcctgcccccagaggtggagtctacagaggcaggcaggcctccttgagctgcggtgggctccacccagttcgagcttcctgg

SEQ ID NO: 12660 - DNA, 856 bp, Homo sapiens
  misc_feature (120)..(121): n equals a,t,g, or c
tattttattttattttattttattttatttttttattttttattttttattatacttttaagttttagggtacatgtgcacattgtgcacgttagttacatatgtatacatgtgacatgnnctggcgctgcacccactaactcgtcatctagcattaggtgtatctcccgatgctatccctcccccctcccaccaccccacaacagtccccagagtgtgatattccccttcctgtgtccatgtgacctcattgttcaattcccacgtatgagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaactgttcctatttctccacatcctctccagcacctgttgtttcctgactttttaatgattgccattctaactggtgtgagatggtagctcactgtggttttgatttgcatttctctgatggccagtgatgatgagcattttttcatgtgttttttggctgcataaatgtcttcttttgagaagtgtctgttca

SEQ ID NO: 12661 - DNA, 878 bp, Homo sapiens; identical to SEQ ID NO: 7383
  misc_feature (741)..(741): n equals a,t,g, or c

SEQ ID NO: 12662 - DNA, 37874 bp, Homo sapiens
ttttatttttaaaatttattattatacttcaagttttagggtacatgtgcacaatgtgcaggttagttacatatgtatacatgtgccatgctggtgcactgcacccactaactcgtcatctagcattaggtatatctcccaatgctatccctccccctacaccacgccacaccagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatccttttttatggctgcatagtattccatgctgtatatgtgccacattttcttaatccagtctatcattgttggacatttgggttggttccaagtctttgctattgtgattagtgccgcaataaacatatgtgtgcatgtgtctttatagcagcatgatttatagtcctttgggtatatacgcagtaatgggatggctgggtcaaatggtatttgtagttctagatccctgaggaatcgccacactgacttccacaatggttgaacagtttatagtcccaccaacagtgtaaaagtgtttctatttctccacatcctctccagcacctgttgtttcctgactttttaatgactgccatttaattggtgtgagatgatatctcattgtagttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaagattttctcccattttgtgggttgcctgttcactctgatggtagtttcttttgctgtgcagaagctctttagtttaattagatcccatttgtcaattttggcttttgttgccattgcttttggtgttttagacatgaagtccttgctcatgcctatgtcctgaatggtgttgcctaggttttcttctagggtttttatggttttaggtctaacatgtaagtctttaatccatcttgaattgatttttgtataagatgtaatgaagggatccagtttcagctttctatatgtggctagccagttttcccagcaccatttattaaatagggaatcctttccccattgcttgtttttctcaggtttgtcaaagatcagatagttgtagatatacggcgttatttctgagggctctgttctgttccattgatctatatctctgttttggtatcagtaccatgctgttttggttactgtagccttgtagtatagtttgaagtcaggtagcatgatgcttccagctgtgttcttttggcttaggattgacttggcaatgcgggctcttttttggttccacatgaactttaaagtagttttttccaattctgtgaagaaagtcattggtagcttgatggatatggcattaaatctataaattaccttgggcagtatggccactttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtgtgttactggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctcatttattgacagttttttgcatgaagggctgttgaattttgtcaaaggccttttctgcatcaattgagataatcatggtttttgtctttggttctgtttatatgctggattacatttattgatttgcatatattgaaccagccttgcatccctgggatgaagcccacttgatcatggtggataagctttttgatgtgctgctggattcagtttgccagtattttattgaggatttttgcatcaatgttcatcaaggatattggtccaaaattctcttttttggttgtgtctctgcctgactttggtatcaggatgatgctggcctcataaaatgagttagggaggattccctctttttctattgattggaatagtttcagaaggaatggtaccaattcctccttgtacctctggtggaattcggctgtgaatccatctggtcctggactcttttttgttggtaaggtattgattattgccacaatttcagagcctgttattggtctattcagagattcaacttcttcctggtttagtcttgggagactgtatgtgtcgaggaatttatccatttcttctagattttctagtttatttgtgtagaggtgtttgtagtaatctctgatggtagtttctatttctgtgggatcagtggtgatatcccctttatcattttttactggaaggtggttcttttcactgggatctcataaagctagcaaattactttctgtgggatgactgagcccatggaaacgcaggcattcttgtcatgtctaataatgggatgtagttcctcccagtccactgtctcctctccttgttttctgctgttatagactgcatcagccaacattatgcattctgaattctccaggagggactgaagcagtcatctcaatgttcacacgttcctccaaactttaggggccacatgtcagtttgtttcagaatcttctcatcccagggttatgtggagatttggctgcacatctctgcagctcagcaagcctgaggtgagaattgagacactgctttctttgccttgcaaaatgcaccactcacttaacatatgggagcacttgtgaaaagaagacaagtcagaagcccttctcttcccttggataacatctcattgcgtggacgactctttctctctcaaaatactccataattctgcatttgagaggccagaggtggtaggttggtagccggtttggctgcttattaggaagccctaggaaaggtgcctagtgagtgctctttagaatcccttctgttaactattctcaatatttagggtttagctgaaatgtttgaaacaaagaaaagtcctatttcacatcttgtacttttaaagcactcatttacatctaaagaaatgtgactgtagaagttaggttatattccctaaggccacaaaatttacttattaaaagtcaaaatctgatttgtctgtaggttattctcaccccaaacctccttttcagttcattgtactatttacctccaaatatgattgttcaattataagtggttactgtagggcatgtgtaagttgagataaacagcaacagaactcttcagtatttatttagatacagcataaaattgggttttgatattgtaggcatattaaggctagccagcttaattggctcctgcatttgtgctaacaactattagtctttaccccccagtaagtgaagaaaatacttgatatagctaaagtagtacctagctcattctgagacttcagtaaatattggttaaatgagagactgcaggaattcaaagtgagctgatgctgccactcccaacaaacagtgacttctgctgagttttttctgatacttttactgtgaaggtctcacttttgttcatgcatctgtcatcaacccttatattcaaggaaatgtctccagaatttttattggatgactgcattttccttacatgcaagtaaaagaaataccaggctttgaaagcgggctgattgagtgagagttgaacatttaatcagcaagaacgcacttaaaagtgccaagttgtagcaaaatctagggaattttaactttacatatgaaatccttttctgctccactatagcctcaactttctttcagtttttaaatttagaacattctggtaaatggccactgcagaagagtttaatatggtacaataataattcttatttttctcttactgctcaaaggaaaaaaaatctggataaatcccagggacctttaaggagttttagaaactgtcctcttcattaggttaatccactaaagatcaattagttaaaatgctatttgaaatatttagttcttttcttagagataaagtattcatttgtaaattgaatctattgaagatatttccatataaaataaagagtgaaaaacaaaaaaaaaaattgaatcacagctgctttatgtggactgatagataccttagtgcatttgcagcacaaatccaacatttaaaatatttaaaaatacatctctgtatgtggaattttagaaagtattaagctatagtgagagaaagctgatcagcctgaaggagttggggaggggcttgactgtaaagagacatcaggaaacattttcaggagttagaaatgctgtctatctcgactgtgatagtggttacaggaatatttcctagttgcccaaatttacccaatggtatacttacacaatgggtgaatcttttgtatgtacattaaagctggcgggtggggagaagaggaaaaaaaatcttattgaatttgggctattttacttgtaatatcttttatcctgataaaacagatagtactgtggtagacaaagtgttttatcatctacatagaataataaaatctcaaatttcaaatgttattcattcactgttagtcaattggcattaaagtgttgctttctgtgtttcaggaacagtgcaatttgtgaggtacagaaagccaaataaaacagtctttgcctaaaggaagtgtaattcattatccattgctatgtaacaaattaccgcaaagtttaatggcttaaaacaccacacatttctcatctcagttatcatctgtgagtcaggtgtccaggtgttgcttagttggtatctctgtctctactttggggtatctcacaagactgcaatcaagaagtcactcaggcctgggatctcatctgaaagctagactggtaaaggatccgctcccacgctcacttacatagtcgttggcagaattcagtacttcaagtgctgttggactgagggcctcagtttcttactggctgttgaccagaagctgccctcagttccttgacaggtgaccctctccatgtgactccttcatcaaagagtgcaggctgaaaaggcaatagatggtcagttaggaaagggaagtcacaattttttataacccagtcacagaagtacatcccttcaatgacgctatgtactgttgcttagaaggaagctacccaagaaaagggaattaacaaggacatcaatatcaggaggaggagaccactggcggtcattctaaaggctacttaccactagaagcctagttgattcaacttactatccaggattaatacatcaagaagtcatccagcaagtgctttaatcttttctgctacacagaatagtgtataagagtggtggctttataatcagacttctcttgcttaagttgtcgctaacccttattagccatatatctgggaatttattaaaccttctaagcatcagtttctcaccataaaatggtgtatacctcataaagtgtgaaaattaaacacaataatgaatatatagttctgagtatggcacctggcaaatagtaagcatgcaaataatgataattattttttattatatatctacttactttattcctcacttgaaatccagctctctgaattttcctgttgttgaaattagtttaccaacttggaacttattaatcaccatatccactttaaaatcctcaccctgcctttaatttacatctgaagacagtgtatttgttgccttcattttctccctacttgtgcacactccagtcttccactgtttctacagatgttccttatgtaacatgatttcaagtgtcgttcacttccttctgaccacatttgttgcattataacataatgaatctgtaagtcatcacatacaactaaataaattccaggtgtagcttgttccatgcaaaaggaatcaagattattactagtgatgtaaataacctatatgtattgaacaattttaagtagtttttaactagtacaatgatattcatgaatctttttcttgaaaatgatagtagtttacaaatgatctaaggagcagcaaatattattaaacactttgcgtacttccatccagatttatcaaaattgttatgaagctgaaagcatagtgcaagaatacagtttggtgcctcatggttctttttatgtactttgtttaatataaggtgatttagcaataatatgattaggatgcttactgtaaaaactccttatctctattattgcttaggcacatagtttttttatagttgtaagacatgaaatatttatctatatgctataatgaactatttactggatataccatatatatgatgcttattcactggtgataaacccatgattgtttttaaatatagattttcatgattagattaataatggaattcacactctttgatagttcaccattatatgcaaaggttttttacaaaaatgatagaagttccaaatattttttcccaagttcacaattcttacaagctcacataaaaataggaagtgtggtttttctcaggggtggcattttctcattattctccttagaaaacataataaagtgaagttcatttactcatttatttttggctttaatattaaacacaaaatatatttttattggaaaggtcaacattgtttatttctgcttgttaaagtatacatgttcctggtaaaacatttaggaacaacaaaaacacaaagaagaaaataaatattaccataactcatagacaattgctgacccatttaatgcatattttagacaattatcataagatcactttttttctgttggaatattagtattttattaaatgattttttaaaagtccttgtatacatatatacatacatgtagtgaagatttaggcttaaagcattttttatttctgtctttgttgtcactgttaggatgctttatttctgttgcaaccacattgtgtcctcttattattccatttctaataaaaaatatagaataacaatattaaaacataaatttttccttgtatgttgtttgtgaatttttgagtgaagttgttttcaataactcagaattttgagttgaaaatacgtgaggatttctgtgatcaaatatttgttatctttttgtaaagagtgctgatttgattagttctaaaaatcatcagtgtaatctgtaaatgatgtaatccgccatcagcacttgcacttttcttcagattattatagaaattcaaatcaataacattttgttgttttctattaaataacatttggcacattacgtatgttcatatggttaccaatattccttaaaaatagcaaggttttaacatgttcatgatatccttaggtagagtctaataacagagaacatttgtgtgaggataactattttaaaatatactctcttttttgaaatagattgtgaaataatctttggtaaaatctctatctttgttaaaaattcccagaatgagaaatgtgaatgtaaaatacttagaaaacttcctttcctagggatgtaaatttcactattataatctttatttataagtcactcgttaaaatggtcttgcttctaggataagaatgcagttcttcatagaataatatctaatttgaagttttgctaatagttttggaagtgaatgtatttttttaaagttttaaatacattcattttagcatattgctttgactatatggactaatttatcaattaaaatatttctattttcatttgatagtaatttttttcaaaaacttatattgtttataaactcagcaagtcttcagaaacatgtttgagtttgttgtatgcatccagattaggtcctagatcaggatgcttttgaattaacttgaaataagaataatatctatggtctatttttatttgaaagttttaccttcccatgatgggctcattttgttaaggatttctttaaaaatttgtggcatatatttgaaatgaagctgcctaaaagataatttatatagttcttaaaagatcatcaaatctcaggtctgcatttaatatttcaaccagtaatgttattgtgctttaaaaactctggtaagataaaagtagacttttacaaaatgaaattgtttcatttattcactcattcattcattcaataaacattaaagaacccttgttcatgttccagacactgggtatataatcacctgtggactagaaggaaaaatgacagacacagaaaccattttaaagaagataatacattattgttaattatagttaattaaagaaaattaatgaaaattcctttgatataaatacttaggtcttacctatattagtaatgtccacctatttttaattaatagagattagcaactctgaaatttataaattgttaaagtttttcagtaagcttttaaggttgtgtgagatatagttttagaaaatatttgaaaaaaaaagtcacattaaaatgatcaggattgtcttttgtttctgttttataatcaagggcctaacatctaatatgtaaatattcttctagtaagcaattaatgtggttattataatcttattattcatagaatatcccccccgccccataaatatcaacttcctaatccccagaacttgtctaagttacatggcaatagggacttagctaatgtggtcaacgatcttgagaagggaagacaatcttggattacccagttgggcccaatgtaattatacagtcctagtaagaggcaagccagaggatcaaagacagaaggaaatggacaacagtggcagaggccggggtgatgtgccttgaaaatagagggagggctccagccaagggcaccttctgggatctggaaaaggccaggaaacaaaaatttctcccagaaggagtgtaccactacctataccttaattttagtcctgtaagactcctttcagacttctgacctccagaactgtagaaaataattttgtggtattttaagtaatttaaatgtatgataattagttacagaaacaataggaaattaatacaaacctacacaattataacattgtaaaatggcctctgttgtgacaatttaacaaaatgccaggttttttccccagaaaaatccctgcagagatgattagctattagagcagagtgtgaaaccttttaacaaaggtaggctagctggtaactgcccattattaccaactaagtctttgaaggtagcaaagcaatacaaaagcaggtactcgtgtaacctaggccagaaccaccacatttattgatttttcatagcttccttttaactgaatccccagataccactagaattttatgaaatgacttaagaataagacatttgaacatgaaaatttaggtgtttcttcaactgtcacacattcaaagagcccctcctggtaatctgtgtgatcatgttcttgcatcagtcgcagacaagcaaaaagctgaactcagtactgcacctcctgttttctgggagtatttaattttaagagagacccatacttccttttataaggtgaagggaaaagctgtaatagcttctttgccattagttttgaaactctagagttcattaaaactccctttggctttcttcactgccatctttctttcttcttatgaattattcaagacaaatttcacttgaggtaaatagtttgatttgaaggtttttgtatctggatttagatgcaacaagaagtgttaaatgctcagaattttaagtgtagagaatggcacagactcagctattaagatggaagacatttgctgttaatgttccagggctgctgttgcgacttcagcttggtactattattcattctgaagtaggcaggcattatgatgcctgcagtataaatcagattttacagagagcttgatccgcaagcactttgaacattccatccacttctcagttaacagaacattttttggttttacaaggtaaagtttcttttttttttatccttgccaatacattattaatctctttttttcatatattgtataccaaaccacaaaacagttttagactatacatgtctcttgaataaagcgaaattgtaagttttgaaagtttcttctttcaataaatattgtgaaagataagaggacctagaaaatatttcatttttataaaactcaacgtaagaccctttcttctttcacagtagtaatatcttttctagatattgtgtcataattttaatcttttaaacacttagctcatggagtcacacacctggaaaaatgatacatggaacatatgtctgaaaactaccttattttggaacttaagaattggttcaatgaatgtaccacatttaaaaaccaatccaggccagtgcagtggctcccacctgtaatcccatcactttggaaggccaaagcgggtcgatcacctgaggtcaggagtttgagaccagcttgaccaatatggtgaaaccccatctctactaaaaatacaaaaattagccaggtgtgttggcatgcgcccgtagtcccagctactcgggaggctgagacaggagaattgcttgaatccaggaggcagaggtggcagtgagccaagatctcaccactgcacttcagcctgggcaatagagtgagactctgtctcaaaaaaaaaaaaaaaaaaagaactatgcaaagaaatcttattatagttttgtctgctactaaaattcactttcctaatgtcagtttctattaaagttgcctagataaaattatgtttatgaaattatgcccaggtagtactgctttcaggcaaagcatttcattcccgtttcctgctctaacacaatatcacaagcagcaggagtttcattactaaagaataataaaaaacatttattaattgctatatgatagaacatgtgctaagtactttacatgcatcacctaagttaatgctcacaatgagtcttagaaatagtttctgttagtgcccccattttatagctagacagttacatggagagcacagtcttgtaatccctctgtaggacatcagaatccatgtccttaaagactaccaataagtgcaaactcaaaatgtacaggaacatagatttatgaagttgcctagtataatgcaatatgaaatggtggatactgtaacaaattgtcaacaatttacatgcatttatatttaaactacaaatccagcaaccaataatttatttgtgggctatattcaggtttcagccctctggtttttaactcaccacaaagccacactgctttcaaaaccgttcatttacatgcataattattcctttatttatttcaatcttattcagattttatcaggcaatggaaacatgcagagaacagaattacattgtaattacattgtaatcacaatgtcttataaccctttccatggtaaaggattacccattagcccagtcatgtagtttacctgttgttagaagggaagaaggaattctcttctaagtctgaaggagacacaggttgagaatcttttatccaaaatgcttgggggccgggtgtggtggctcatgccgtgggtggatcacttgaggccaggagttccagaccagcctggccaacatggcgaaaccctgtctctactaaaaatagaaaaatttgccaggcatggcggcacatgcctgtaaccacagctacttaggaggctgaggcaggagagtcactcgaacccagaggcagaggttgcagtgagtcaagatcgtgccactgcacttcagcatgggtgacagagtgagactctgtctcaaaaagaaaaaaaaaatgcttgggaccagaagtgtgtcattttttggattttggaatatttgtatatacacaatgaaatatgttagggatggaacccaattctaaacataaaatttatttatgtttcgtatacacgttatacacagagtctgagggtaatcttatacagtgttattaataattatgtgtgacctgtcacttgaggtcaggtgtggaattttccaagtgtggtgtaatgtcaacactcaaaaattttcggattttggagcatttggagtgcagattttcagacttgggatgctcagcctgtgctggaattgcaagaatgttcagactcaaaagtcaaagaaaaagttgagttctgaagagggcacattaattgaaggggccaacaaaatgtattaaaatttagcctgtagtgctcagtgtcttattgccatgaatatgagagtgatggtggctaaggaagggaactggagccatatttctaaatcgggctttatattttgtaggtgattgtgccagccatagtgtaaggcagacatgagtcatttttcaagggacttgggatgaagtgcatgtaaattttggacatgaaaatttaagggcgaaagagatgtttaaatcctctaaggaaagctatgggaaagctgtgtaggcaccattagtttatttggatcatgaagtccaggtaagagattttcatgttcatgtgtcaagtaacaaagataagtaggaaaagtgttgtcatgtgttttattatttaataaggaaatacattttgttatgaatgaatacatttttttcttggcgtgtttaattggtattccttctcaaaatgtccaatgactcatcaacttagttatggcaggcatcttaatttgttaagttgcttaagttttctggttgttcatttccatgaagctgtgtgtgggatttataagctttttcccccaatggatatgctaataaaatacaaagtttgaaaatcactgagactgattaatcatattcctgtcagctctaaaattcagcagctcaacagtcagttatgtcaagggtgtccattatctgatcattctttctactgaaatgtgctttcttttcttcttcttttttttaatcttttcttctattctgttactttctattaaaaaatgaacttcattgaatcttaactcaatgtttcagtgtggggaaggtttactcaccattatggaacatttgaaaatatgtaagaggccaggcgcgatggctcacacctgtaatcccagcactttgggaggccgaggcgggcggatcacgaggtcaggagatcgagaccatcttggcttaacacggtgaaaccccgtctctactaaaaatacaaaaaattagccgggcgcggtggcgggcgcctgtaatcccagctactcgggaggctgaggcaggagaatggcatgaacccgggaggcggagcttgcagtgagcccagatagcgccactgcagtccagcctgggcgaaagagctagactctgtctcaaaaaaaaaaaaaaaaaaaaaaaaaaaaaaagaccttactattagcatttagtaaccagttagggatattgttaaacatcatgcagtacatcagagaatattcttatgtaaaagatcaatagcactgtttttgagacatattgaaatgggttatgactctatagcctgacagacattgcagtaaaactttttttttttttctgataaggactttaatttctggatttatttggtcatgctctctgcctcaagcacctttctagttaccctgtcaaaaatcttgtttgctcttgaaggcttagttcagatctcatctcctttgtgaaatcacttgtaaccctttcactttactataaactcagaggtctccctactttttgatggcccttgtataatctcttgaacacaagcttgaataatctccaaatgcaatggcaaattgagaaaaatggtactggcttttccattctgctttccgtgtgagttgtgtaaaagggccaagacatatcacttttgttttgttttatttaaattattgttcctacagagaaatagatgataaatactgaaataatagtgagtcatccttatacacaaaaacatcaccatagcaaatatgctacctaagataaacatgctgcatagctcaacctaactttacttatttgtagttaattcactataagaactcattgagagtacagcatgaaacttgttttttaatatcctttcttgctgattgtgtctcaaatccataacttagattttaatatatagactacctgatgataataatggtgttctagaaataaaggcagctttcggagcttctcttaaaaaaattaaagaccgtctacatgatcaactacctaccagttaactgaaacaagactgggtatcactggcccactgtcctagttcaaactcaatgaaggaatcaacactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccatatcctctccagcacctgttgtttcctgactttttaatgatcgccattctaactggtgtgagatggtatctcattgtagttttgatttgcatttctctgatggccagtgatgatgaacattttttcatgtgtcttttggctgcataaatgtcttcatttgagaagtgtctgttgatatcttttgcccactttttgatggggttgtttgttttcttcttataaatttgtttaagttcctggtagattctggatattagccctttatcagatggatagattgcaaaaattttctcccattctgtgggttgcctattcattctgatagtttctttttgctgtgcagaagctctttagtttaactagatcccatttgtcaatttttgcttttgttgcaattgcttttgatgttttagttatgaagtctttgcccattcctacgtcctgaatggtattgcctaggttttcttctagggtttttatggttttacgtattacatttaatctttaatccatctcaagttaatttttggataaggtgtaaggaaagggtccagtttcagttttctacatatggctagccagtttttccaacataatttgttaaatagggaatacttaccccattgcttgttttcgtcagttttgccaaagattagatggttgtagatgagtggtgttatttctgagggctctgttctgttccattggtctatatctctggtttttttttttttttttttttttttttttaaccagtaccatgctgttttggttactgtagccttgtagtatagtttgaagtcaggtagcgtgatgcctccagctttgttctttttgcttaggatcatcttggctatatgggctcttttttggttccatatgaaatttaaagtagtttttttctaattctgtgaagaaagtcagtgatagcttgatgggaatatcattgaatctatgaattacttttggcagtatggcattttcacaatattgattcttcctatccatgagcatggaatgttttttcatttgtgtcatctcttatttccttgagcagtggtttgtagttctccttgaagaggtcctttatatccactgtaagttgtattcctaggtattttattctctttgtagcaattgtgaatgggagttcactcattatttggctctctgtctattattggtgtataggaatgcttgtgatttttgcacattgattttgtatcctgagactttgctgaagttgcttatcagcttaaggagttttgggtctgagacaatagggtttctaaatatacaaacatgtcatctccaaacagataatttgacttcctctcttcctatttgaatacgtttatttctttctcttgcctgattgccctggccagaacttacaatattatgttaaataggagtcgtgagagagggcatccttgtcttctgctggttttcaaagggaatgcttccagcttttgcccattgagtatgatattggctgtgggtttgtcataaatagctcttattattttgagatatgttccatcaatacctagtttattgagtgtttttagcatgaaggagtgttgaattttgttgaaggccttttctgcatctattgagataatcatgtggtttttgtcattggttctgtttatgtgatggattacatttattgatttgcgatgttgaaccagccttgcatcccagggatgaagcctacttgattgtggtggataagctttttgatgtgctgctggatttggtttgccagtattttattgaggaatttttccatcgatgttcatcagggatgttggcctgaaattttctttttttgttgtgtccctgccaggctttggtatcaggatgatgctagcctcataaaaagagttagggaggagtctctctttttcttttgcttggaaatttttaaaagtaatggtaccagctcctcttggtacctctggtagaattcagctgtgaatctgtctggtccagaagttttttttggctggtcagctattaattactgcttcaatttcagaacttgttattggacctaatagacatttatagaactctccaccccaaatcaacagaccatacattcttctcagcacaacataacacttattctataattgaccacataattggaaataaaacattcttcatcaaatgcaaaagagtgaagatcataacaaacagactgtcagaccacagggtaagcaaattagaactcaggattaagaaactcactgaaaaccacacaactacatggaaactgaacaacctgctcctgaatgactactgggtaaataatgaaattaaggcagaaataaagatgtttcttgaaaccaatgataataaagacacaacataccagtatctctggaacacagctaaagcagtgtttagagggaaatttatagcactaaatgcccacagtagaaagcaggagagatctaaaatccacaccataacaattgaaagaactagagaagcaagagtaaacaaattcaaaagctagcagaagacaagaaataattaagatcagagcattactgaaagatccagagacatgaaaaacccttcaaaaatcaatgaatccaggaggtgtttttttgaaaagattaacaaaatagatagaccactagccagactaataaagaagaaaagagagaagaatcatatagacacaataaaaaatgataaaggggatatcaccactgatcccacagaaatacaaactactatcagagaatactgtaaacacctctatgcaaataaagtagaaaatctagaagaaattgataaattcctggacacatataccctctcaagagttacagttttaaagatgactttgattttcaagttttaacaagagaatagaattgtttcttcaaatacactaatatatttttgtaggatattacataaaactgtagataaggatgtgtctaaataaattcatgcttaatttttaatcagtttaataatctagatattttcattcttttttttttttttttttttgagacagagtcttgctctgtcacccaggctcagtggcacgatctcggctcactgcaagctctgcctcccgggttcacgccattcgcctgcctcagcctcccaatattttcattcttaatggataattaccataatctagaaaaacaatgcaagacaattgcagacttttgttaaatatgaaaaagcaaggtaattctgtaccatttcatacctaaagtaaaaaaaaaaaaaaagaataacaaaaagttaactgtaccacctatttttattctaaatatggagcatagtattttatttaagtaaggaactgttatatgtatgcttacatttcctaagacatcttcagagcattacttttttcatgttcttaaatggctatacaagtagtgtaaatgttcaatagccagaattctgtatgtaatatatctaagtgttatatatgtatgcatatctaagtgcttattctctttccagagagattatgaattttcaggatttaggaagtccagttatattgcctcttgtgaccttgggttgtacacccactttgaaaatcagtttggcaatatgaagccatatgggagtagtgatgaaaaataaatggagaaaaaaccctatcttctgcttggtttactacctaacatttgggaatataatattaggtaaatatattcaaatatattgtggatcagaaagtgctgggtaagtggaaaataagaggtggcacttctgggcattttcttttgatataaccattttgaataaaccatttacacaaacatacgcatacaacctcttacctaggaacatcaaaactgaatatttaaattatgtagtcaggaaacatttcgactaccatgggccctaggagtctaaggcatgttgaaatgaataaaataccaatactttctggaagcattaaggaacctcatgcattcagtatttgctggaatttgtccttttggcattgaaaagagataatgggtgattacactgtcaaaacttctaattctcaaatataatcttcaaaggagtgcctgtgcagacataggcagaataattttaatggaccttgaagcatctggaaacatagaaagaaaccttgcatagcaacacaggaacattgctgatatttttgtttgttctctctctctctccctctctctctctctctctatatatatatatatatacacacacacactcacacacacacacacacacaaacacacacacacacacaagaatatattctgtgtggtcttgaatgagctattcaaagtctccatctgtcatttccatatctatggaatggaagtaattatgatgatacagcatgggtttagtttgagtgtgaaatcaggcactgcataaatggcacgcaaaagagtgcctggcaaatgataagtactcaatacttgtgttgggaagaccacaccactacatagcttcctgcctttcctcatcatggggaatagttccatatttaagagaatatgaaagcagtgaacagtatcttattttgaaaaaacttttcattatgacagatttcaaacatgcaaaagtagagacaatgagtgaatgaaggaatccccatgtgtctatcattcttattcaattatcaacaattatcagtatctacagtgttaagataaataatttgcaaaggtagtgaaaataccttggctcaaaactgaacatgttcagaaccccatatactttacatatctcttgaggtaatagatttccctatgtctctgtaacaaataaatatatttacctatattctgttgttagatagatgggtttgaggaaaacaaattcactaaatgcagaatcaacttttacaagaaaaagaaattataaatgaaaagcttttaaaattggttcagtttgcaaaactgatactaagaaaatatgtcaatacatttttcatcagaataataatattagctaaaatcatagattgcttctatgaaacaggcttagcatcatctcaattttcatagcaaccctattaattaaggaacactctaattatcattatatagatgaagaaattgaggttttgtaaatgtaaacaaattgtccaaggcaagtggcaagactagaatataaatccagggctgtctctagagattattcgtaaccactataacatatctcaaaacattttagtcattagcctaataaaccaagaataagaacgctatgaaaccttattttacttaaaaaaaagtttttttaaacttatttattttaattatatctgtaatgatacattttataaaatttataaatgtttaaaatgtcatccacatgggattaaaagaaaatcataaatctcatcagggacaaaatggaaggaattttttcagaccatttttctgttgaacacaatagaagtttagcttaaatatgcactttaattaccccatattttgattccttgatttcaacaaaaagttctgaggttacttagaaaaaaacctagcatactctaatgagattttcagtaaatagaaaaactctgtcatatatgccatacaaagacaaataaggttcaaagtaataaaatatgtcatccagcaaaatctatgctacagatttaatgatgatgacaataatttagccaaggccagctgctgtactaatagaccccaaatccttgtaatggcacaaaacaacagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaagaaaaaaaaagaaactgtgcattaaccttttaaataaatatttttaatagtatcacccttaaatgcttagcacaatgctataattaactttagtcatcctgatatggaaaaagtagtgggataattatctcttaattatgtgacgaggaaagaaaatgtaattttgacctccccaagtgggtaaatgactaagattagaagccatgtccactcattactagatcctgcataatcttgcataaactaatatcaaatattttaacgtttgaaagtatgctaaatgtttatcagagcaggtgattttatttcattgagttctcatttactcatgtatatgttaatttatctattatgtattcaaaattactcaaatattgtattgagtgctctaggataaatattaataagtgaaaattaacactaatatatctctgattctttgcaatgtgtataattaattacctgaactggacactattgagagaaaagggatgcttttaataatcactccagaacaacaggggacagcttctggaaaacagggacaaataattattctgttggtccacctgattttaagttttccaataatagaatttcagaggagagctatcatagagctcatttaatataattgcactttatagacgaagaaatctgaggcccagtgaaaagaaataataatttctgtatattaatgtttctcacttaagtttatgacattttttaatgaagaatgattgatatgagactttttccatcgtatactcctcttgtactggaccaaagattgttgtcttctaaaacaatacgtacttcaactaagatcctaaagaccataattaaatcttaacacattaccaggtatctctatttattcttttagagcacaaatccactttttctaaacctattaagaactaagtatgtgttgcatgaagttttaaagtaatatttcatcttacaatccagaaaactcttttatattctaatggctctatgatgttgtagaacaaatgacatgtcattatttgaccgagaatggaactaaacccaaaaatggcccagccacagaatcttaaaatcttctattaatatggtctctggtaaatataatgagctgaaacacaacttctatggtatttttagagataaacattattttctcttgaaattctcacagtattcttttagtgcttacatgtcagatgtaggtttttaattgttaaacatgaaaaatactctgataatttaactactcctaaatttaagtgtatatatgctttcttttttgttcacagtaatgtaggagaagcagtgttaaatgatgctaggaatctgtactctagaaccggattgcctaggttcaaattctgatacaaaaactctatggcttttgaaacaaggcttacatttctaaccagcctattcatcactgttctcatctgtaaaatgggattcattatggtaataactacataatccagaacagataagtaaatgatttaattaatataaaacaattatcagagtgtatctgtcatgtattagacataataagcgtaagctttcatcagtatgttatttctttaaaaaaatccctcttttctctgccttataatttttggataattttttccaaatataaactggtaaattataaaccagttaaaatatcaggacattattgtttacaatatgtcgtttttaaaaactaattaagatcacattgcagtgaagaatgaccccatttaatatatattgacattatatttttgagcattttgtagattaaataaaacaaaaaaagatttaatacgaaacattttctatgtttgataaagttgcatgtatattatcactgttattttcttacctgttaaggaaaatattaccccaaatttaagttggaattttaaaaatgcatactattaagagtgaataagagtttatattctgcttgaattcctggtttatgacatacatacaaaatgagaaaggaaataaactctaggatgaatcttattttagtaagttaatggccttttcactgaaagtaggaaatatttcttctttcaaaagcacccaagatcaataaataatcttgatttaggaaatatgacaatgcaaacttttttcaaaatctgcttaaaaatgtaataaacaccatatcaatgggaatgtggtaataatcagaacaaattttctcaaaaatatatctttttttaagaatgagcaaatcaaatattttggactttattttttcccatggtattatcattaagaatatctaccccaatgtctgctttctccactttcatgcctaaactacagaacatcactggacaaaataataacatcttgctgatggggtccactacccatgacacttcagattagctctcagttggtgttttacagtattttatttccttgttttcattttctagtgactccattttacagttctttcagtgacttttctaaaatttaacagttctgagtgtcatcatactgcttctattccctctccctttaaccagatgatctcaaatccatcaatatggggaacattgaattctttttacttttttttttcctggttttgttctttagaagaacaagaagttcccttcaacagttttcaaccaaacatctgtcttcaagttacatcttcatcatctcaccatcctgaggattaaatgtgataatctatgtaaagcacttaacaaaatatcaggcacttaataataactattatctatcttttcccctagtgaatagtgggcaaagtttcaaccattgattatttgtttaaatacttttatttcagtaaaattgcttgcctttgaatatattttgccagtgctgaaaatcgtcatatgtcttctaatatccaaaaattactgaataaaatagtggttaggagcaaaggggcaggggccagacttcctaggcttaaatgtcacctttgccacttacaagctgtatgacaattgtcaaagacttaaacttgcctctgtatcctcatttggtaagttatttaaaaaaattatctctagtacagtaaagaagaagaagtatgataatatacacaaaatgcgtagaactgcctgccacatgctaagtactaacaatactagctgttattaattttcactgtgtctaaaattcattatttcagcaaatatctattgaaaccctattgaaaactaattgtgatgtgtgattttaaaggacaatgataattatattacttattgtctagacagcaaaaaaaaatacaaagatacaaatcaaagtacaaattatattaaaagctatgaggaagtgtcaggttatcagaggggatgttatcaaatttggaaaatcaggcaagctgagattcttagagtttgtaggtgctcattacaattttattttattttttctgatagtagtaataacatattttctgactatgataaaagccaaagtgttatctatgttctttacgtgaaagttcacttagattctctttctcatatggattatagattgtcccttattcaggaaagcaggacattttttggtctgaagagatttccctctgggtttcatttgtatcaaaagtgaattgtgaatcccaaaggcattcacattgtaagatgatactactagttgggatactgaggttccatttttattcctttaatagcttcctaattatagattccttttcctttaatttcagcctctatattaatgataaaactaatctgcaatctctctcaaataacttttatgctaaaagcaattaggtagatattttcttggctccttagagaggaaatagatttagatatgcagaaagagctttgtcattaaggacccaggtaactacgatcctctaacagttaatgacacaaggaactgggctcaagtagagacatatagtttaaagtgaaaacattttgacctgaaattccaaggtgcacctggtaattggtgaccttaacaagtggttatgacagcaaagtcctacagtttgtggaagatagaaagcaaattcactaaaaggaaaggtaagaggaggaagcaaagagaaagaatgcaacagagaagaagaaaaaagaataaaagttttccctaattaaatgcttactatcatccctttctcactgctattttataatattaattttatatattactaattaaaaactatataattatatacataattaatttttttctggttcttcaaaatatttgactaaataatttagaggtctcaaataaaaatggtaattttaagaccactgtgatcaagttctggaaatttttaaagatctaggaactttttaaagctttaatattttttgattatttttatattttatacaacatttttactaattccaaagaattataaatgactattatgtatttttatttggaaacattttggttatttgggaaaaagtaggtgttagtccagctatacattgtatgtttactgatggagaaaaaaaaaatccctcttgttattagacactgttattttactgatacccaaattctatatatttagatatggtttgggatgagctgtgtaacttatttggacatgtgaacatctttcactatatgttttgcatatgaaaaaaattatctcactttgccttttatttaatgattctttgaaatatattctttgtataaaccttataaagttgtcaaaattaattttcaattagaacatccataaaagtgccaagttattataactactgccttatgattcactcaaagtaaaggataaatccataacattttctattaattgaatagataatcttcattttacaaatgatttccatatagaattagtgttacgataggcagttcttagtgaaatcaatatcagcttatttcctattttgagtcatgaaccaaatcattgtcgtcatcattaaatctgtagcatagattttgctggatgatataatttattactttgaaccttatttgtctttgtatggcatataagacagggtttttctatttactgaaaatctcattagagtatgctaggtttttttctaagtaacctcagaactttttgttgaaatcaaggaatcaaaatatggggtaattaaagtgcatatttaagctaaacttctattgtgttcagcagaaaaatggtctgaaaaaattccttccattttgtccctgatgagatttatgatttttttaatcccatgttgatgacattttaaacatttataaattttcatgaaaaccattttcatatctgttaatataaattactctatcaataattattttttgtagcaaagaaaattaacaatactttgccatttttgttcactttggcctcctcctgatgtcattcttcattttatccacatttcattaatgtgcattttataaactatgctaaaaatagcctcttttgaccacatgtgactgtgactcagaaagtttacttgcatctgtgcttcaaatgactaaacatttttggtttctataatggcaggtgaagggaattaaagaagaggtaaagtaaatattttaactggtgtataatatggttagatcatcctgtttttgtgccttccactatgatttgattacttctaagataaatgatttcgagcatatttgacgtgcaaatatatttaagattcaactatcaacatttgcttagtaattaaaaatttagtttttcaaaaaatgctgagtgccattttgtagctgcagatgaaatttcctaatatcgggaaatgaattgtttttatttgtttgtgtgtctgtttgcattttcccatggcttgctggtgcttatactttatttttcctcaattataaaaatattgttctaaaagagaccttagagttctacacagcaacccacttacacagctcaggaaacatgggccaagagagatgaatgttctgcttcttcagtggttcttacccctgaatgtttgtggtaatcatcggaagcacttgagacccaaggtcagacttctaccactggcagctctaaaatccaagttcggggtgggtcctgaattgtaatttttaaagtcataggtcactggaatggtctgtcaaggctgaaaatacctactcatgcatttagtcttatagaaaggacataagggttattgtgatttcttactagtagaattgaaattagcattaaggcacttaatactcccttcactctaatattctgcctctgtttttttttttttttaatggaagttattctacttgcagacactcgtttttttttttttgtttttttgttttgttttgttttgttttgtttttttgatggaggctcattctgtcacccaggttggagtgcaacggtgcaatctcggctcggctcactgcaacctccacctcccaggttcaagcgattctcctgcctcagcctccctagtagctgggattacaggcgcctgccacgacgcttggctaatttttgtatctttagtagagatggggttttgccatgttggccatgctggtctggaactcctgaccttatgatcgacccgcctcggcctcccaaagtgctggtattacaggcgtgagccaccgcgcccggccgacactcttgttcatccagaaatctggtcaccagtttccttgccagtatctaccagcccattctgcaattctgacggaattattaaactcctctgtgccctaggggcactattgccttatgcacagataacatctaggagacactggtttttttttctggtatatgtaacaaaaaagtaacaaaagcaaattgctgaattgccgttacaatagtacttaattaatatgtatgtataactgtatatgtgtatatttatgtacttagtgtttctgtatttgtattgtttttataggaaatgcactgattctctaatattaacacaaatcctcttcattcaataggtgttaaaaatctctaacacacttgtcagtgctctcagatatgagtatcttttcattgtcaagtcgcagattcatgtctgatttcagaactttgtaaggccagtgaaagtgagtgacgaaggatcatttaaagacaaggtacaaatagcttgtagatatgtttgtatcatataaatttactgtttatgtggcattttgagatctcttacccaattgacaccctttggcaatgaaagtgaatccttcatttatccactggttttatttattcactatttttcattcattcaacatttattgagcattcactctgtaccagatgcaattctaaaagctgggaatacaaaagtagacaaaagtatacctcattctggtcctcatcacacctaatagctactggtcaagacagacattaaatatcatccaaataatcataaaatttactgtggtgagtgcaataatccagggatctaaactagtctgtgcaggagtggaggtggataaaggcccaggggcaggtaaggctctcctgagaaggtggcatttaggaagtagtaagtaggcaaagaggctgaataatagttcccatatgaagagagaagaataaatgaaaaggtgttggcactttcaaggaactgaaagaaaaagagggaaactggaaagtgacatttttacaagtatttgaaacctttttttttcatgtgtaaatgtgggattacttttacctttgcagaaataatatattggattgtaagagttgttttcctgaaggtcatcaaaaattagaatggccattttcctaatttgtcttattatggcagtctcagtattaacaacaggtccagccctctttcagaaaacaaaatattaatagtgacctttttactcctaaatgcattctagtttggatagtaaatcttatggttagcctatctagaataaaagaatatactttacccaattcttaaagttgcaaaggaaggaattctggtaaatgcatacataggaaagtgtagccttcttactttttgttttgtataatgtcttggtatagggaaaataagctaccaaataaccaaccaacattttaacttctcttattttcttccttttttccttccttttcttgttacttttcaaagtgcaagtaaccaatattatggaatgtctaccttatgcatggtgcagtgccaggcaatgggtatgtagtagttaaataggcaggaattagaacaaaaaaaaaaaaagaggaaacaagatgaatttgagggggtgctttgagagggcatgagagcagctataatatgtgctctggttaggagaagaaaaacatagtatttttaagatactgttggagactagtgaccttttcttaacgtttaaaaatataacaagagagtcagttttttctgattcttcatgtcctaagacacaagaatctcttgggcaaggtaggatcctccttggaggacagaaattagaaagtctgaatcagaatcctcagtatttggcagagggaaagaagatactggggaaaagagcatggcttattttcttttcatggtgacactacttttctattgggttgcaactaaatttgggaggttgacacagtatcataaaagcaaagaaagatatccagccctatagtctttttttttttcttttatgatgtaccttcctaggtcaactgagttttgcatattcctcattgctgggactgtagtcacctctctttttattctcactacaatgggaaataactgtcttcagatatcaacagtgtggattccttttaggctagatttcccacacttaaatatcctagtgttatatcagggacgaggagacaagacaaagagacatgccattttcatatttatatttttcccctctccaattctttattttccctccaattccagaaaactcctagcacttctcaaatgggaacatattaaaatcctagcaagtattttaaaaattctattgatagtctcaaggcttcagctttcggaaattaaaataattttgcttctctatttggttcttctttctttttcagtaaaagcacctacttgaagacatagagatcttttcccctactaagttgcccaacaggagatgatcagtttaaagaaaatgtggaaatacaaattcaatctgtaatgcatcacctggttttttccaacacacaagtaattgacctctttatattctgatttaagttcctaagtatttgtgtttgacaagatctgtagtgtctgacatagggcatcctcaaacagcacggtgccaaaaaatatggggtcagaatggttgggttttaattgtgactctgatagttactgattacggaaccttgggcacagtatttaactagtctatatatctgcttcctcatctgtaaattggaagttattataaagccttccatatagacttcttatggaaataaaatgaaataattcatacgaataccctggcacatattaggtactcagtgaatgttagctagtattacaaatgtctatgacaatttaattagcatgatgtctagaaccgccattatttgattagaattagtttagcaggaggatgaaaaaactgagaaggaccctaaaatgagtagccatgctgttttatttactcctttctttatttaagacatgaacaacactctaggtacagttttatattttaatggctatgttgtcttctcttcgtccttacatgaaataccctcaccctctcccccagaaaaaaagaaaagaatcattccattgttagaatgcagtttagagattataaactccaaactctgtacgtcattaaaatttatattcactgggaccttgaacttagtcttcaacttttacatgcaataccattagtttatttaagttcagttgattcactgtttgtctccctccacaaaccaacctcttgcatcagatgttctccttaacttgcttagaggcctgccatttctttggatttttttttccattttatcacctgaaacctcatttccatcttaagtaggcctcccatgcattgtctaagtatctccctaataattcccaacattttcttgtcccaactgcagcctagttctctctttaatagaattgttttacatccctctcttgttgcagatatgatttctctccaactccgtatgtaaaaaagataaggtgaaaagaggatattgtgagcaactcagtttcccttgccacttcccagattggtagtccaaccccttctctgtgtctattccctccagccatgctactattaatttattcttgtggtctccttgtatattcacagaggactttgcgttgtggctcatagtcttcttgttcaccataatttatgacatcatgagggctccttaagttttcttgagccttttggtattaacgtctgtcaatcccattctgctttagcaaactcactgtctgccatcacttctgggttttcttcctttgtttcctttgttctgcctggaactcactgcctttccaacattttcattgtctttatcccattctgcatctgtaccattatccctaaaacttgtcttcatctaataatttacttggctagtactatcctgagaagtctattagaactgctactacaaatttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccccctccccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatatcatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagac

SEQ ID NO: 12663 - DNA, 4822 bp, Homo sapiens
attttttttttatactttaagttctagggtacatgtgcacaatgtgcaggcttgttacataggtatacatgtgccatgttggtgtgctgtacccattaacttgtattttacattaggtatatctcctaatgctatccctcccccttccctccaccccacgacaggccctggtgtgtgatgttccccaccctgtgtccaagtgttctcactgtccaattcccacctatgagtgagaacatatggtgtttggttttctgtccttgctatagtttgctcagaatgatggtttccagcttcatccatgtccctgcaaaggacatgaactcatccttttttatggctgcatagtattccatggtgtatatgtgccaccacattttcttaatccagactatcattgatggacatttgggttggctccaagtctttgctattgtgaatagtgccgcaatgtgggcatgtgtctttatagcagcatgatttataatctttgggtatatacccattaatgggatggctgggtcaaatggtatatctagttgtagatccttgaggaatcgccacactgtcttccacaatggttgaactagtttacagtcccaccaacagtgtaaaagtgttcctatttctccacatcctctccagcacctgttgtttcctgactttttaatgattgccattctaactggtttgagatggtatctcattgtggttttgatttgcatttctctgatgaccagtgatgatgagcattttttcatgtgtctgttggctgcataaatgtcttcttttgagaagtgtctgttcctatcttttgccccctttttgatggggttgtttgatttttttcttgtaaatttgtttaagttctttgtagattctggatattagccctttgtcagacgggtagattgtaaaaatgttctcccattctgtaggttgcctgttcactctgatggtagtttcttttgctatgcagaagctctttagtttaattagatctcctttgtcaattttggcttttgttgccattgcttttggtgttttagtcatgaagtccttgcccatgcctatgtcctgaatggtattgcctaggttttcttctagggtttttatggttttaggtctaatatttaagtctttaatccatcttgaattaatttttgtataagatgtaaggaagggatccagtttcagctttctacatatggctagccagttttcccagcaccatttattaaatagggaatcctttccctatttcttgtttttgtcaggtttgtcaaagatcagatggttgtagatgtgtggtattatttctgagggccctgttctgtaccattggtctgtatctctgttttggtaccagtaccatgctgttttgaatactgtagccttgtagtatagtttgaagtcaggtagcgtgatgtctccagctttgttcttttggcttaggattgtcttggcaatgtgggctcttttttggttccatataaactttaaagtagttttttccaattctgtgaagaaagtcattggtagattgatggggatagcattgaatctatgaattactttgggcagtatggccattttcacgatattgattcttcctatctatgagcatggaatgttcttccatttgtttgtgtcctcttttatttcattgaatagtggtttgtagtcaaaccttgaagaggtccttcacaccccttataagttggattcctaggtattttattctctttgaagcaattgcgaatgggagttcactcatgatttggctctctgtttgtctgttattggtgtataggaatgcttgtgatttttgcacattgattttgtatcctgagactttgctgaagttacttatcagcttaaggagattttgggctgagacgatggggttttctaaatatataatcatgtcatctgcaaacagggacaatttgacttcctcttttcctaattgaataccctttatttcttcctcctccctgattgccatggccagaacttccaacacttcattgaataggagtggtgagagagggcatccctgtcttatgccagttttccaagggaatgcttccagttttttcccattcagtatgatattggctgtgggtttgtcataaacagctcttattattttgatgtacgtcccgtcaatacctagtttattgagagtttttaggatgaagggctgttgaattttgttgaagaccttttctgcatctattgagataatcatgtggtttttatctttggttctgtttatatgatggattacatgtattgatttgcatatgttgaaccagccttgcatcccagggatgaagcccacttgatcatggtggataagctttttgatgtgctgctggattcagtttgccagtattttattgaggatttttgcattgatgttcatcagggatattggtctaaaattctctttttttgttgtgtctctgccaggctttggtatcaggatgatgctggcctcataaaatgagttagggaggattccctctttttatattggttggaatactttcagaaggaatggtaccagctcctctttgtacctctggtagaattcggctgtgaatctgtctggtcttggatttttttttttgattggtaggctattaattattgcctcaatttcagagcctgttgttggtctattcagggattcaacttcttcctggtttagtcttgggagggtgtatgtgtccaggaatttatccatttcttctagattttctagtttatttgcgtagaggtgtttgtagtattctctgatggtagtttgtatttctgtgggatcggtggtgataccccctttataattttttattgtgtctatttgattctttcttttctctttattagtcttgctagttgtctatcaattttgttgatcttttcaaaaaaccaactcctggattcattgatattttgaagggttttttgtgtctctatctccttcagttctgctctgatcttagttatttcttgccgtctgctagcttttgaatgtgtttgctcttgcttctctagttcttttaattatgatgttagggtgtcaattttagatctttcctgcttcctcttgttggtatttagtgatataattttccctctacagattgctttaaaagtgtcccagagattctggtatgttttgtctttgttcttattggtttcaaagaacatctttatttctgccttcattttgttatgtacccaatagtcattcaggagcacattgtttagtttccatgtagttgagcagttttgagtgagtttcttaatcctcaattccagtttgattgcactgtggtctgagagacagtttgttataatttctgttcttttacattttctgaggagtgctttacttccaactatgtggtcattttggtataagtgcgatgtggtgctgagaagaatgtatattctgttgatttggggtggagagttctgtaatgtctattaggtctgcttggtgcagagctgagttcaattcctggatatccttgttaactttctgtctcattgatctgtctaatgttgacagtgagatgttaaagtctcccattatttttgtgtgggagtgtacatctctttgtaggtctctaaggacttactttatgaatctgggtgctcctctgttgggtgcatatatatttaggatagttagcgcttcttgtcgaattgatccctttacaattatataatggccttgtttgtctcttttggtcttagttggtttaaagtctgtttgatcagagactaggattgcaacccctgctttttttgttttccatttgcttggtagatcttcctccatccctttattttgagcctgtgtgtgtctctgcacctgagatgagtctcctgaatacagcacactgatggatcttaactctttatccaatttgccagtctgtgtcttttaactggagcatttagcccatttacatttaaggttaatattgttatgtgtgaatttgatcccatcattatgatgttagctggttattttgctcactagttgatgcagtttcttcctagcattgatggtctttacaatttgtcatgtttttgcagtggctggtaccggttgtgcctttccatgtttagtgcttccttcaggagctcttttagggcaggcctggtggtgacaaaatctctcagcatttgcttgtctgtaaaggattttatttctccttcacttatgaaacttagtttggctggatatgaacttctgggttgaaaattgtttcccttaagaatgttgaatattggcccccactctcttctggcttgtagagtttctgccaagagatctgctgttagtctgatgggcttgcctttgtgggtaacccaacctttctttctggttgcccttaatattttttccttcatttcaactttggtgaatctgacaattatgtgtcttggagttgctcttctcgaggaatatctttgtggtgttctttgtatttcctgaatttgaatattggcctgtctttctagattggggaagttctcctggataatatcctgaagcatgttttccaacttggttccattcccctcatcactttaaggtataccagtcagatgtagatttggtcttttcatatagtcccatatttcttggaggctttgttcttttctttttactctttttttctctaaacttctcttctcacttcatttcattcatttaatcttcaatcactgataccctttcttccacttgaacgaatcggctacagaagcttgtacatgcgtcccgtaattctcg

SEQ ID NO: 12664 - DNA, 5381 bp, Homo sapiens
tatgtatattattatttttttctttttttttttattgtactttaagttttagggtacatgtgcacattgtgcaggttagttacatatgtatacatgtgccatgctggtgcgctgcacccactaactcatcatctagccttaggtatatctcccaatgctatccctccccgctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgttttctgtctttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgcttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttcttcttttggcttaggattgacttggtgatgcgggctcttttttggttccatatgaactttaaagtagttttttccaattctgtgaagaaagtcattggtagcttgatggggatggcattgaatctgtaaattatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcatctgcaaacagggacaatttgacttccgcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatgttggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggataccctctttttctatcgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttctaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcatggtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgtttggtagatcttcctccatccttttattttgagcctatgtgtatctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaaaccgacctttctctctggctgcccttaacattttttccttcatttcaactttggtgaatctgacaattatgtgtcttggagttgctcttctcgaggagtatctttgtggcgttctctgtatttcctgaatctgaacgttagcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgaaccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaggcttcttctctcagctcgtcaaagtcattctccaaccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgcttgggggtcaggggtcagggacccacttgaggaggcagtctgccct

SEQ ID NO: 12665 - DNA, 26439 bp, Homo sapiens; identical to SEQ ID NO: 7958

SEQ ID NO: 12666 - DNA, 6025 bp, Homo sapiens
tttgagtcttttttttttattattatactttaagttttagggtacatgtgcacaatgtgcaggttagttacatatgtatacatgtgccttgctggtgcgctgcacccactaactcgtcatctagcattaggtatatctcccaatgccatccctccccctccccccaccccacaacagtccccagagtgtgatgttccccttcctgtgtccatgtgttctcactgttcaattcccacctatgagtgagaatatgcggtgtttggttttttgttcttgtgatagtttactgagaatgatgatttccaatttcatccatgtccctacaaaagacatgaactcatcttttatggctgcatagtattccatggtgtaaatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatgatatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttctttcgagaagtgtctgttcatgtccttcacccactttttgatagggttgtttgttttttttcttgtaaatttgtttgagttcattgtagattctggatattagccctttgtcagatgagtaggttgcaaaaattttctcccattttggaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggggttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgcggcgttatttctgagggctctgttctgttccattggtctatatctctgttttggtaccagtaccatgctggtttggttactgtagccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattgccttgggcagtatggccattttcacgatactgattcttcctacccatgagcatggaatgttcttccatttgtttgtatcctcttttatttcattaagcagtggtttgcagttctccttgaagaggtccttcacatcccttgtaagttggattcctaggtattttattctctttgtagcaattgtgaacgggagttcactcatgatttggctctctgtctgttgctggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaactgccctggccagaacttccaacactatgtcgaataggagtggtgagagagggcatccctgtcttgtgccagttttcaaagggaatgcttccagtttttacccagtcagtatgatattggctgtgggtttgtcatagatagctgttattattttgagatacatcccatcaatacctaatttattgaaagtttttagcatgaagtgttgttgaattttgtcaaaggctttttctgcatctattgagataatcatgtggtttttgtctttggttctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagaaattcaacttcttcctggtttagtcttgggagggtgtatgtgtcgaggaatttatccatttcttctagattttctagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaacaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagagcgtctttatttctgccttcatttcgttatgtacccagtagtcattcaggagcaggttgttcagtttccatgtagttgagcggttttgagtgagattcttaatcctgagttctagtttgattgcactgtggtctgagagatagtttgctataatttctgttcttttacatttggtgaggagtgctttacttccaagtatgtggtcaattttggaatagccgtggtgtggtgctgaaaaaaatgtatattctgttgatttggggtgcagagttctgtagatgtgtattaggtctgcttggtgcagagctgagttcaattcctgggtatccttgttgactttctgtctcattggtctgtctaatgttgacagtggggtgtgaaagtctcccattattaatgtgtgggagtttaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgtctttttttgttttccatttgcttggtagatcttcctccatccttttattttgagcctatgtgtgtctctacatgtgagatgggtttccttaatacagcacactgatgggtcttgactctgtatccaatttgccagtctgtgtctttcaattggagcatttagtccatttacatttaaagttaatattgttatgtgtgaatttgatcctgtcattatgatgttagctggttattttgctcgtttgttaatgcagtttcttcctagtctcgacggtctttacattttggcatgattttgcagcggctggtactgattgttcctttccaagttaagcacttccttcaggaactcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggtttgtagagtttctgccaagagatccgctgttagtctgatgggcttccatttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgctcgtttctttttattcttttttctctaaacttcccttctcgcttcatttcattcatttcatcttccatcgctgataccctttcttccagttgatcgcatcagctcctgaggcttctgcattcttcatgtagttctcgagccttggttttcagctccatcagctcctttaagcacttctctgtattggttattctagttatacattcttctacatttttttcaaagttttcaacttctttgcctttggtttgaatgtcctcccatagctcagagtaatttgatcgtctgaagccttctctcagctcgtcagagtcattctccatccagctttgttccgttgctggtgaggaacagcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggctgtgtgaggtgtcagtgtgcccctgctggggggtgcctcccagttaggctgctcgggcgtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaagcaagcctgggcaatggcgggtgcccctcccccagcctcgccgccgccttgcagtttgatctcagactgctgtgctagcaatcagcgagactccgtgggtgtaggaccctccgagccaggtgcaggatataatctcctggtgcgccattttttaagcccgtcagaaaagcgcagtattcaggtgggagtgacccgattttccaggtgccatctgtcacccctttctttgactaggaaagggaactccctgaccccttgcacttcccgagtgaggcaatgcctcgccctgcttcagctcgcgcacggtgcacacacccactgacctgcgcccactgtctggcactccctagtgagatgaacccggtacctcagatggaaatgcagcaatcatgcgtcttctgcgtcgctcacgctgggagctgtagaccagagctgttcctattcagccatcttcgcc

SEQ ID NO: 12667 - DNA, 5676 bp, Homo sapiens
aatgtgattttacatttttttttttattattatactttaagttctagggtacatgtgcacaggtgcaggtttgttacatatgtatacatgtgccatgttggtgtgctgcacccattaactcgtcatttacattaggtatatctcctaatgctatccctcccccctccccccaccccaaaacaggccccagtgtgtgatgttccccttcctgtgtccaagtgttctcattgttcaattcccacctatgagtgagaacatgcgacgtttggttttttgtccttgcgatggtttgctgagaatgatggtttccagcttcatccatgtccctagaaaggacatgaactcatcattgtttatggctgcatagtattccatggtgtgtatgtgccacattttcttaatccagtctatcattgttggacatttgggttggttccaggtctttgctattgtgaatagtgctgcaataaacatacgtgtgcatgtgtctttatagcagcatgatttataatcctttgagtatatacccagtaatgggatggctgggtcaaatggtatttctggttctagatccctgaggaatcgccacactgtcttccacaatggttgaaccagtttacagtcccaccaacagtgtaaaagttcctatttctccgcatcctctctagtacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatccttcacccacttgttgatggggttgttttttttcttgtgaaattgtttgagttctttgtagattctggatattagccctttgtcagatgagtagattgcagaaattttctcccattctgtaggttgcctgttcactctgatggtagtttcttttgctgtgcagaagctctttagtttaattagatcccatttgtcaattttggcttttgttgccattgcttttggtggtttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttgttaaatagggaatcctttccccatttctcgtttttgtcaggtttgtcaaaggtcagatggttgtagatgtgtggtattatttctgagggctctgttctgttccattggtctatatctctgttttggcaccagtaccatgctgttttggttactgtagcctggtagtatagtttgaagtcaggtagcgtgatgcttccagctttgttcttttggcttaggattgacttggcaatgcaggctcttttttggttccatatgaactttaaagtagtttttcccaattctgtgaagaaagtcattggtagcttgatggggatggcattgaatctataaattaccttgggcagtatggcccgttttcacgatattgattcttcctacccatgagcatggaatgttcttccatttgtttgtatcctcttttatttcattgagcagtggtttgtagttctccttggagaggtccttcacatcccttgtaagttggattcctaggtattttattctctttgaagcaattgtgaatgggatttcactcatgatttggctctctgtttgtctgttattggtgtataagaatgcttgtgatttttgcacattgatttttgtatcctgagactttgctgaagttgcttatcaccttgagattctgggctgagacgatggggttttctagatatacaatcatgttatctgcaaacagggacaatttgacttcttcttttcctaactgaataccctttatttctttctcctgcctaattgccctggccagaacttccaacactgtgttgaataggagtggtgagagagggagggcatccctgtcttgtgccagttttcaaagggaatgcttccagtttttgcccattcagtatgatattggctgtgggtttgtcataaatagctcttattgttttgagatacatcccatcaatacctaatttattgagagtttttagcatgaagggctattgaattttgtcaaaggccttttctgcatctattgaaatgatcatttagtttttgtcattggttctgtttatatgctggattacatttattgatttgtgtatgttgaaccagccttgcatcccagggatgaagcccacttgatcaaggtggataagctttttgatgtgctgctggattcagtttgccagtattttattgaggatttttgcatcaatgttcatcagggatattggtctaaaattctctttttttgttgtgtctctgctaggctttggtatcaggatgatgttggcctcataaaatgagttagggaggattccctctttttctattgattggaatagtttcagaaggaatggtaccagctcctccttgtacctctggtagaattcggctgtgaatccgtctggtcctggactttttttggttggtaagctattaattattgcctcaatttcagagcctgttattggtctattcagagattcaacttcttcctggtttagtcttgggagagtgtatgtgtcaaggaatttatccatttcttctagattttctagtttatttgcgtaggggtgttcatagtattctctgatggtagtttgtatttctgtgggatctgtggtgatatcccctttatcaatttttattgtgtatatttgattcttctctcttttcttctttcttactcttgctagcggtctatcaattttgttgatcttttcaaaaaaccagctcctggattcattgatttttttgaagggttttttctgtctctatcttcttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatattgtgcctttattctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggccaattttggagtaagtgcagtgtggtgctgagaagaatgtatattctgttgatttggggtggagagttctgtagatgtctattaggtccacttggtgcagagctgagttcaatttctggatatccttgttaaccttctgtctcattgatctgtctaatgttgacagtggggtgttaaagtctcccattattattgtgtgggagtctaagtctctttgtaggtctctaaggacctgctttatgaatctgggtgctcctatattgggtgcatgtatatttaagatagttagctcttcttgttgaattgatccctttaccattatgtaatggccttctttgtctcttttgatctttgttggtttaaagtctgttttatcagagactaggattgcaacccctgcctctttttgttttccatttgcttggtagatcttcctccatccctttattttgagcctatgtgtgtctctgcacatgagatgggtttcctgaatatagcacactgacgggtcttgactcttcatccagtttgccagtctgtgtcttttaattggagcattcagcccatttacatttaaggttaatattgttatgtgtgaatttgatcctgtcattatgatgttagctggttattttgctcgttagttgatgcagtttcttcctagcatcgatggtctttacaatttggcatgtttttgcagtggctggtaccagttgttcctttctatgtttaatgcttccttcaggagttcttgtagggcaggcctggtggtgacagaatctctcagcatttgcttgtctgtaaagtattttatttctccttcacttatgaagcttagtttggctggatatgaaattctgggttgaacattcttttctttaagaatgctgaatattggcccccactctcttctggcttgtagagtttctgccaagagatcagctgttagtctgatgggcttccctttgtgggtaacccgacctttctctctggctgcccttaacatttttgccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccaacttggttccattctccctgtcactttcaggtacaccaatcagacgtagatttggtcttttcacatagtcccatatttcttggaggctttgttcatttctttttattcttttttctctaaacttctcttctcacttcatttcattcatttgatcttccatcactgataccctttcttctagttgatcgaatcagctactgaagcttgtgcattcgtcacgtagttcttgtgccatggttttcagctccatcaggtcctttaaggacttatctgcattggtgattctagttagccattcgtctaatcttttttcaaggtttttaacttctttgtgttgggtttgaacttcctcctttagctcggagaaattcgatcatctgtagccttcttctctcaacttgtcaaagtcattctccatccagctttgttccattgctggtgaggagctgcattcctttggaggaggagagatgctctgattttttgaattttcagtttttctgctctgttttttcccctctttgtggttttatctacctttggttttgatgatggtgatgtacagatggggttttggtgtggatgtcctctctgtttgttagttttccttctaacagtcaggaccctcagctgcaggtctgttagagttttctggaggtccactccagaccctttttgcctgggtatcagcagtggaggctgcagaacagcaaatattggtgaacagcaaatgttgctgcctgatcgttcctctggaagtttcatctcagagggatacccggccgtgtgaggtgtcaatctgcccctactggggggtgcctcccagttaggctacttgggggtcagggaaccacttgaggaggcagtctgtccgttctcagatctcaagctccgtgctgggagaaccactgctgtcttccaagctgtcagacagggacatttaagtctgcagaggtttctgctgccttttgtttggctatgccctgcccccagaggtggagtctacagaggcaggcaggcctccttgagctgcggtgagctccacccagttcgagctt

SEQ ID NO: 12668 - DNA, 6191 bp, Homo sapiens
tttttctttacattaatttttctttttttattttttattttttttattattattatactttaagttttaggatacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcagttcccatctatgagtgagaacatgcggtgtttggttttttgtccttctgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtcttttctattgtgaatagtgccacaataaaaatatgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgcaaaagtgttcctatttctccacatcctctccagcacctgttgttacctgactttttaatgattgccattctaactggtgtgagatggtatctcattgtggttttgatttgcatttctctgatggccagtgatgatgagcattttttcttgtgtcttttggctgcataaatgtcttcttttcagaggcatctgttcatatcctttgcccactttttgatggggttgttttttttttcttgtaaatttgtttgagttcattgtagattctggatattagccctttgtcagatgagtaggttgcaaaaattttctcccattttgtaggtttcctgttcactctgatggtagtttcttttgctgtgcagaagctcttgagtttaattagatcccatttgtcaattttggcttttgttgccattgcttttggtgttttagaattgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgagctatatctctgttttggtaccagtaccatgctgttttggttacggtagccttgtagtataatttgaagtcaggtagcatgatgcctccagctttgtttttttggcttaggattgacttggcagtccttttggttccatatgaactttaaagtagttttttccaattctgtgaagaaagtcattggtagcttgatggggatggcgttgaatctataaattaccttgggcagtatgccatgttcaccatattgattcttcctacccatgagcatggaatgttcttccatttgtttgtatcctcttttatttcattgagcagtggtttgtagttctccttgaagaggtccttcatgtcccttgtaagttggattcctaagtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttctttctcctgcctaattgccctggccagcacttccaacactatgttgaataggagtggtgagagagggcatccctgtcttgtgccagttttcaaagggaatgcttccagtttttgcccattcagtatgatatttgctgtgggtttgtcatagatagctcttattactttgagatacgtcccatcaatacctaattttttgagagtttttagcatgaagtgttgttgaattttgtcaaaggccttttctgcatctattgagataatcatgtggtttttgtctttggttctgtttatatgctggattatatttattgatttgcatatattgaaccagccttgcatcccagggatgaagcccacttgatcatggtggataagctttttgatgtgctgctggattcggtttgccagtattttattgaggatttttgcatcaatgttcttcaaggatattggtctaaaattctcttttttggttgtgtctctgccagtctttggtatcaggatgatgctggcctcataaaatgagttagggaggattccctctttttctattgattggaatagtttcagaaggaatggtaccagttcctccttgtacctctggtagaattcggctgtgaatccatcgggtcctggactctttttggttggtaaactattgattattaccacaatttcagattctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggattggtggtgctatcccctttatcatttgttattgcatctatttgattcttctctctttttttctttattcgtcttgctagcggtctatcaattttgttgatcctttcaaaaaaccagctcctggattcattaattttttgaagggtttttttggtctctatttccttcagttctgctctgattttagttatttcttgccttctgctggcttttgaatgtgtttgctgttgcttttctagtttttttaattgtgatgttagggtgtcaattttggatctttcctgctttctcttgtgggcatttagtcctataaatttccctctacacgctgctttgaatgtgtcccagagattctggtatttgtgtctttgttcttgttggttttgaagaccatctttatttctgccttcttttcattatgtccccagtagtcattcaggagcaggttgttcagtttccatgtagttgagcggttttgagtgagtttcttaatcctgagttctagtttgattgcactgtggtctgagagacagtttattataatttctgttcttttacatttgctgaggagagctttacttccaactatgtggtcaattttggaataggtgtggtgtggtgcagaaaagaatgtatattccgttgatttggggtggagagttctgtagatgtctattaggtccacttggtgcagagctgagttcaattcctgggtatccttgttaacattctgtctcgttgatctgtctaatgttgacagtggggtgttaaagtctcccattattattgtgtgggagtctaagtctctttgtaggtcactcagcacttgctttatgaatctgggtgctcctgtattgggtgcatatatatttaggatagttagctcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcgtttccatgtttagtgcttccttcaggagctcttgtagggcaggcctggtggtgacaaaatctctcagcatttgcttgtctgtacagtattttatttctccttcacttatgaagcttagtttggctggatatgaaattctgggttgaaaattcttttttttaagaatgttgaatattggcccccctctcttctggcttgtagagtttctgccgagagatcagctgttagtctgatgggcttccctttgtgggtaagccgacctttctctctggctgcccttaacattttttccttcatttcaactttggtgaatctgacaattatgtgtcttggagttgctcttctcaaggagtatctttgtggtgttctctgtacttcctgaatctgaatgttggcctgccttgctagattagggaagttctcctggataataccctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcatcttccatcactgaaaccctttcttccagttgatcacattggctcctgagacttctgcattcttcacgtagttctcgagccttggctttcagctccatcagctcctttaagcacttcgctgtattggttattctagttatacattcgtctaaatttttttcaaagttttcaacttctttgcctttggtttgaatttcctcctgtagctcagagtagtttgatcgtctgaagccttcttctctcaactcgtcaaagtcattctccgtccagctttgttctgttgctggtgaggaactacgttcctctggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtgtctgcagaacagcggattttcgtgaaccgcgaatgctgctgtctgatcgttcctctggaagttttgtctcagaggagtacccggccgtgtgaggtatcagtctgcccctactggggggtgcctcccagttaggctgctcgggggtcagggatcagggacccacttgaggaggcagtctgcccgttctcagatctccagctgcgtgctaggagaaccactgctctcttcaaagctgtcagacagggacatttaagtctgcagaggttactgctgtctttttgtttgtctgtgccctgcccccagagatggagcctacagaggcaggcaggcttccttgagctgtggtgggctccacccagttcgaccttcccggctgctttgtttacctaagcaagcctgggcaatggcgggcgcccctcccccagccttgctgccaccttgcagtttgatctcaggctgctgtgccagcaatcagcgagactccgtgggcgtaggaccctccgagccaggtgcgggatataatctcctgatgcgccatttcctaagcctgtcagaaaagcacagtattagggtgggagtgacccgattttccaggtgccgtctgtcatccctttctttgactaggaaagggaattccctgaccccttgcgcatcctgagtgaggcagtgcctcgccctgcttcagctcgcgcacaatgcggtgcacccactgtcctgcacccactgtctggcactccctagtaagaggaacccggtacctcagatggaaatgcggaaatcacccgtcttctgcgtcactcacgccgggagctgtagaccggagctgttcctattcggccatcttggctcctcccccccatt

SEQ ID NO: 12669 - DNA, 7939 bp, Homo sapiens
ttttttttttttttttttttttttttttgcttctgagagttgttttttattttttattttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttggttatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactggagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcagttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcatctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagctcttccttcaggagctcttttagggcaggcctggtggtgacaaaatctctcagcatttgcttgtctataaagtattttatttctccttcacttatgaagcttagtttggctggatatgaaattttgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatactctgccatgtgaggtgtcagtgtgcccctgctggggggtgcctcccagttaggctgctcgggggtcaggggtcagggacccacttgaagaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgcggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgtgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccgccgcaagattgcttttacagttgctccttcattcattctttctgttttcctgtctaactgctgtagaatgctcatggccttttctggctgtttccagatagaagcaaggtgactcatggggaattcaggtcatttgggaaacaaaagccatcagtagagtctccagaatctatccttctgcttttctgatgtggttagtgagagaaggtagtgacatggaaacaggaacaatattctagcatctcagcttctacctcctttgaacagcttttcctctctgcatcaatcttgttccaagctattatacgtggaaaaatctccaaagatgcttctaccaatgagtacctacctacaccattggtcacaactgcttaaaaatgagtgaggggtctcagttttgaaactagaattatatgtgactttaaaaaatatatatctatctgtaattttaaactgttttctaataaacacaaattatcagaaaaattttgtaaatacttttttttttaatttaaaaaatatagattttggtagactgccgtgtgacgccttgtcatgtgttaggcatctgtactcagatccaactaaggaagcttcacttgcaaaatgatgtcaagtcacaaggattttacaacttgggagaaagggcttagcaaaacattcccttgctcccctgaaacctagtaggccagtgaaccctggactgggccactcacactgggaatgaaaaaatatgccatcaaaggttgtgtcagctttagaggcaagtcctacttgggatcaatagagacggatgaggaaaggcagccaagtgaaggccactagcttggataccttctggactcggcttggaaggagggacagagatcaccagaggttgccatctgtgatcatcatcaaggcccaagaaagattcacacagccctccaagctcagaggaggctaaggaaaaaaggaaattctacaggtgacaagacagtcatttttttcttcaagaagaaattaattacctgtagatattcttgcaggaaaattgaatattccttttgcttataatcgattccagctcttttatggtgggatcctggcataagtctctggggaagaaagaagaaagtattaaaattacaagatctcacaaacatttttggagtctctttgtttttgtagcacgccctggacaaggcccttggataaagaggtaaagtagaggtaaatcctctaagagctcctgggtcagcaggagagctgaagtgtcaagcagttaaatatcctttgtggagataaagttaagaggctgttgggattcatgcacattcatgtagtttcatttcctgagtcaatttgttcccagtgcgtgcttgtgactgtggattcttttgtggactgattcataaaataacacttgggtacaaagtagtaagatatacctggaatcttctcttccaccatgtatcacccaggcctctagtgtctgaaccttctctggttgcaaattatggacttccacactcccaaaagtgctaaaatagaagaaacaaagaaccccaaacatcaaccccaaacgaaagcatccacacccccctcaacaaccagcaggcagaaaggcactggctaggacctatcctttagagttgacacatcaaattgcaaatcagtcaataaccttttcttattcagcatgaccctcggttaacaagattctcaaaataaaattcttaatttgtgcattaatgttgattctttaaatatttgctatttgaagagtggtccttagaccaacctaatgaacatcacctgggaactcattagaaatgtagaatttcagccaggcatggtggctcatgcctgtaatcccagcaat

SEQ ID NO: 12670 - DNA, 150 bp, Homo sapiens; identical to SEQ ID NO: 7384

SEQ ID NO: 12671 - DNA, 46487 bp, Homo sapiens
tttttgtatttttagtagagacagggtttcaccgtgttagccaggatggtctcgatctcctgaccttgtgatccgcctgcctcggcctcccaaagtgctgggattacaggcgcgagccaccgcgcccggctgaatctcttttgcaatatatttttcacaaactttccacaacttgttcaagccctcagatgtttcctatctaacttaaaataatcctttaaccctctaaactaggcaagaaatccacattcccattccttcttgtaatcttttaccatatgcacattttactttccttgcacaccttgcatgtaaaactgtttctttagtagtttcaaatacatgttacactgttgactcttagcaacttttgctgaaaaacctggttagtaagctattttaattatgtactagatttggagcctaggacaccagacagaagtgcagataaggtctctttccagcatagctagggatatggctaactccacatgtcgttaggccttatctagtggtaaagcaggcaagtcgaacaattttcaaaagccaaagaagcagtttatgaccttaaagcatttagcaaacctaatatctgacttgcataatttagaccaaatgtctaaatttttgaagatatttttattttaccaataatcctaaaactgtctttatttcccaaagattatttaggtcacatgaactaaaaggcattacagtttaaattttctgacaatatttaagcatttattttttaacaccaattaattagagctcttttatataaacatcatcacacacaacacatatgaatacatagaagattcagtagttgtaagatttttcatttgccactttttgtttcttaattggattattggcttcagggtggagtctttggaagaacagcgtggagaaagcatacagtttccagagcctaataagcagatacagctggaaggcaaaaatggatccccaaaattaagggaccatcgttatagtggatcctgaatccccaaaagagaaatgctacggagcaagacagtacaatgattttaccatacatttcattgcaaagtgatccaatgccaatcagcccattccccatgggaatcttatctctcagtgggggctggggatgttgccgtaccttccaggtggccaagagcatgcttctctgatccaaatgtgcaagtattcctccataactgccattagccatccatatatttcctacctggttattaccaaagttctttcataatgtgaagtaatttctgaaactcccaaaagtgaaaaacaggtaacgcaatgcaaacagaacagagccttagattttaagagggatctatccactttcaattcctggggttccatgaggaaaccagaggtttttcccaaaacggggtctgtggcacctcctctttttttcccaaggagtcccaagctgttagaaattatcttaggtcctttcatgtgtgcatcaagagtggcaagaagacaaaataagaaaagcaattcagttgactgagaacaaaaaacctttttttcttcagaaaaataagattcaagaagagaaaaaaacaaaggccttttaaatgtatgtatagcttggatatctgcttttaactaagctgacttttaaccatagtgttcctaagaaaatccttttaaatctcttattacttgactttagcttagccaaatagccaatacttgtggtttttgaactttaccaaaagtaacctcacaggtgaaaccaataagccttaactaaggttatgacttatccatgagtgtatgacgtatgttcaaagaggtggtaagcagtttttacaagatttagagtctacaaaggtagcttcgacaaaggaaaattcaagaagggaagtcagaagtcattcatggaggggcagagaatacattgatttctaccattcctactactggtttgcatagaaagagagaagccagaagtctggtaagaattcctaccagtctaccagcatgcctggctgctggcttctgggttccctttccctgagcagccctagcgaccctgcttgccacaccctggggaccaagccacaacaccaaggaaaaatcatcttttttccatttcatggaaactttgaactagacaaaagtcattttctgttagaaagttaaggtttgtactgcatgttgccatgtgtgtcctgagaagggggagtagataaagaagttgtctacatactgtagaagttatcccctctcaggagatttctcagttagatttttgctagggcttgtctgaataagtgtgggctattttagacattaccagggaccggtgggtgaatagcaattggtcccttaagtaatataaaggggtgtgaatcttttgttttgagggaggggatgccatttgccccacctaacaggcttagccctgttctctttattctactctgggttataaaagacataagaggctaatctgaggacctcctgcacaggggttccaagtctgactcttgtaattgcttcccagtttctttttaagccaagcagtttaaggtttgaggaaattaaaattttcccagtttgggggaatgcatccaaggggcaagtcctgtggtatggagacacaatttcccatctgccatttgcgaagagagaacagaggaggaaaaagaggaaaagggaaaaaggtgtcctctctttcttcctattatcccaaatggggcatcccccatcatcctgggttctagacttaaccattctttaccatgtacccatggtcccatctcattacaattacccacttgagaacagagaacagaagagatactggagtgaacagtgagcccctgtccatccctggggttccagaattaactggtccttactgtgtacctgcctagcctttcatcttttttccaatggtaatccgttaggctaggaccacccttcttgggttccagacttaaccagtctttactctgtatccatggtcccatctcatcacgattacccactggagaatagaggagatactggagtgaaccgtgggcccctgtccattcctggggttctggaattaattggttcttactgtgtaaccccctagtgtttcatttctgttccaatggtaatctgtcagcctgggccacccttcatctctgtcctatgggtctcttatgtgaaccctgaaaatttgagataggcctcagttaatttagaaagtttattttgccaaggttgaggacacacgccagtgacacagcctcaggaagtcctaaggacatgtacccaaggtggttggggcacagcttggttttatacattttagggagagatgagatatcaattaatatatgtaagaagtacattggttctgtccagaatggtgggggcaactggaagcagggagggggcttccaggtcacaggtaggtgagagacaaatggttgcattcttttgagtttctcataagcttttccaaaggaggcaatcagaataagcttctatcagagtgagcagagggatgactttgaatagaatgggaggcagatttgcccagcttgagtgttccctttagctaggattttgagggcacaagatattttcctttcacacttttatcagtggcctttaaccagcctatatccttgtctccatggccttatagtgactctcactcagaggattttagtaataaaataattatcttttttcttagaagcctgtttctctgttaactgccacagcggctggacttccctccccactcccttagaatatgaccttgaaggtcttgatgcacattgagaagggcatggaagtaattcgagaaatggcggctataggaggaagtggaaagaagcaagaggaatactcatggaaagccttcatgtgctcacaaaaacaggagcccttgtattcaagagggtaatatttatttgccctctgaacataaagccgtaacctctgaggacttggggcctggggtaagaatttctcctcctcccaaagtggtggtggcttaaaaagcaagagggtgggattcttgaaggaccagagtgaagcactatgcaggcagacaagccgcttttaaaagccatcagaaaacttagcgctggggcataataggaacaaaatgcacatgatgagttgtaagaaaccggcagcactggagttccaattagtgttctggccacatgccagcagacaggggaaagatggaatgtcacccgagatagtaaaaacaaatataaacctcgggggatatccacaagggagcctgtgcctttgctgctgcagaaatgcagagagccatgggcgcatgaataatagggagtgtgtgttttagaagtcatgtggcatgcaaagtgaaagcaaagaagcagactttcacccaaggcagaaggtctggtgggcgtgaaaagccattttagaacacacacacagaaaacagaagaatgggtggtatacatttttggaaaagagccaattttagttggaaagaaaaagcagaggaaatcccagacattgcatggtttttaggcctcagcctcaccactctcataagcctcctatctaggagggccatttaatgcttctgacctacttggtgtggaccctaaggtccttcccacccccgcaagccacccattagggtgagctgagaaatcaaccacaaaaagcagagtcacttatggagagagagagagactgacagagagagagagatcgattgattgattgattgggagaatgtaaaggaagagaacaagagtctctgcctggtaatccagggaattcttccgaatcttaaccaagaccaacaagtgttacttccactagtctgcaagaaccacagtgttatagagcttggggcccaagtcccttaaaatacctgtaaagccttccccagattgtgaagagtataataaattcataacttttcaatgtccaaaaatcaaccaacatcaacaagcatcaagagcagccagggaagcataacctcaccagacaaactaaataaggcaccagggaccaatcttggaaaaacagagatgtgtgacctttcagacagagaagttgaaatagctgttttgaggaaacttaatgaaattcaggataccacagagaaggaattcaaaattctatcataaatttaacaaagacattgaaaataattaaaaagaatcaggcagaaattttggagctgcatactaaagaatgcattaatagcagaattgatcacaagaaaaagaaagagaagaaaagagaaaggaaggaaagaaagaagaaagaaaagaaaagaaaaagaaaagaagaaaagaaaagaaaaaactgcacacgggggtcagatgcctccaaccaaagaaggcaaggcatagatatctcttaacatctgagtcacatggccaatatgttaccggtggcaaataaccgagtctcatggtacctaatatgttaagggtaacaagtgtccgagttaccattggtgaatctgtatgggtctgcagcaacctcaattcttgcctcctcagaagaaagaatttgactgaggggcataaggcagaaaaagagaccaaggcaagtttcagagcaagagtggaagtttattttaaaaggctttagaacaggatagaaatgaaagcatgcttgaaagagacccaagtgggcgacttgaaggacaagtgcactgtttaatctcgatcctaggactttataggctggcccttttcccatgatgcttccgttagtgtgggctgcctgcatgcaaggtgccctccttctccttaggaagtgagcatgcacagtgtatttagaaagttatatgcatgcccatctgaggctttctttccttttccagtggagtgctcccagaaggtcatactctgctattttgtctcttaatgcatatgcctgggaagttgcttcaccctcttgcctgcattcaattaacactttagtgcaataggtgtgggccattaggaaatggcctctccctggcaccaactgccaatttttcaattttagagaggcaatgcaataattgctaaatcatcttctgacagtcctagtgggtggggggagagccctcttctgccccaatcatgcctgtctaactccctgtaacataggcatatcatatgcaaactgaagaaagacaaagagaaaatactgaaaaacaaaacaaaacaaaaccccttacttacagaggaacaaggataagaattacagtgcagaaaccatgcaagtaaagaagagagtgggctgtaatatttaaaatattgaaagaaatactaccaacctagacctctgtgattagtaaaattatctttaaacatgaaggagaaataatttctcagacaaacaagaactgaggatattcatcaccagcagacctgccctgcaagagatgttaaaaagaatttcttcagggaaaaggtacaataatataggtcagaaatttatagaaagaaagggcattggagaaggaataaatgaaggcatgcttgctattgccctcatcattcttgtccatctcagtgtgctaatgaaaccacctttgcaaaaattatagctgatgaaattatgacagtgaaagagatcagaccttaccaactccatcttgcttctaaactttaagctgtccttgttcattcctgggtgtaggccaaactaaccttgggaaggaatttagtttatagtttaactctgaaacaaaattgatagtagccctttcccagtcgggggcggggtcgggggggaccttcttgcctggggaccagtctgcctttgtaggcctaacaaattagctacaagattaaaaattatggtttaggggccacacagcctccggctgcaagagtctgaacctccccaaattgctcctgggaataacatcactgttgaaaaatctaaggtcagtacttgagatactttgcagaccctgccttccttgttggaagcaagtaaaactccaaaaaaataaaggagttgtacagcaaactaaactttagttctcaaccaaattttgggagatcagggattctctggaggggggcttccaggcctctgcaagttgtcctattggtttgagccataaagatagctcaagctggtaccaagcacccataggagattcgtgaaggtcaggggcacctccactcagaatccctttgtggttaccaaaatatgaaccccaaatatctgagacaagtctcagtcaattgaggaagtttattttctcaaggttaaggatgcttctgtgacacagcctcaagaggtcttgacaacatgtgcccattgtggtcggggcacagcttggttttgtaaattttagggagagatgagacatcaattaatacatgtaagatgcacattggttctgtccagaaaggcaggacaactccaagaggggaaggggcttccaggtcaaagaaagataagagataaatggttgtattcttttgagtttctgattagcctctccaaaggaggcaatcacatatgcatttatctcagtgagcagaggggtgactttgagctctgtctgtcctttgtccacagggaatttccttgtggaaaaatggtgagggatgtatgtagcttttttttttttaatcttattaactatcttttttaggaatagaatgggaggcagatttgccctaagcagttcccagctttacttttctctttggcttagcgattttaggatcctgagatttattttcctttcacaatagatatatacttataatgcacactttccataaaccatatgtattattgtacaacttgcattttcactttgtattttgagttatttccattttggtatatatagagctacttctttttgatatcatagtagggtagaatagtactttataaatttatcatacttagtttaatcctttccctattgatggtcatttatgtaaccgcccgatgggttcttcctgccagctgcacaaacaaaatcaattcaaggagaccatggcattgcagtaaagaaagaggttaattgatgtggtgctggccacgccaaatgggagatggagtcctgtcttaactcaatctcctgaagaatttgggggctagggtttttcaaaggtagtttgggggaaatcatgggggtggctaggcaatgggtacttggtgctgattggttgggggtgcaatcataggggtgtgggaaatggtcctcctatgtgctgagtcacttctggatggggcctcaggagcagttggtgggtcgaggtggagccagacatgcaagaaatctgaaaagatacctcaaaaggccaatcttaggttctacaatagtgatgttatctgcaggaataattggggacgttgcatatgttgtaacctccagaataacggctgtcaatcctttatgtctacaccttagcaggactcagcctgctccatcctcctagcctggtggtttcattattagctttacaaaggcatttggttaagttttggggaatggctattatcatttaaactgtaaagtaaatgtctcccaaagttagcttataagcccaggaataattaagggcagcttgaaggccaaaggcaagacaggtgttagccagatcagatctccttcactgccataattttctcattgttataatttttgcaaaggtggtttcatttacattatttacaattaattgctattaaaagaaattatgcattttaatattcttgcatatatttacttaaagcattatactagagaaataaaactctcacatcagaatctgcaggcctatgtccttcgtatttaagacaatgtgttaaagttttaatactattaagcttaaaggacaaagccaataagaacacacaaatgttaagaatcataacctagagtgattcatcaaaaagtagtgtgacatgcaattgaaactcctgtttctcttagtatgactagtatctcctaagtcacatatattggtgtgtctgattgaggcatccacaaagggaatacaaatgaccaggaaaatgatcatatttttctgcctctttgtgctctatattttaaaatgcaggtattggtacttttaggaattgcttcacaatctctgtcttcctctcttgctccttccaacactgaaaaaccatacagaaagcagctgtgggtggcatactctgggctaagccctggggttacaggcagcaaagacacacctatgaattagcattgatctgcaaaccacagagggtaccatggaattgtcatgattcagtagcccctcacctccttcaacccttgactgactataccgtctacaatgtgctgagaatacagtggggaacaataccaaaagggtactttcattcaggaaacttccagtctaacaagtcaaactccccatcgcttggaagggagagtaaaaaaatatatatatattcagaagaaaaaagcacatgcatgcattaggcagggtgcaaggctgggagaaaaggaggagttgaggagcgcagctggaatctgggatctgcctcgaggaagtgcgcgaatagtggtcccctctcctcccagaacagtggagaggcgccaagaccatccctacctggtgccatcaaagagagaggactgttacgacctcctgcgagtcctgacagggaaaggccctcttttggggtcaactgtggggacggcgcaatgccaacctgagccaccatttgaaatgagaaaaagcggcgtggcagaaagaaatgagtctggtacagaccagtggttggtttcctagggttagaggtctaggtctaccttctgttagaagaggggcagtggtgaggccttgatgggagccccctgccccagaattcacttaagagcaggtgtaccttcctcccctgcgtggctccatgaagctgggaaagaaacgcacaagaggaccaccctagaggcccaggcttgtttggcctgaaatcgcctcacccctcccagactgcactgctgacaccccctctcccattagcttccaggaaggagagtgagagggctggggagagggaaggggcagacacccagcagtccctggttggggagttggggcgggggtgcagacacaccaaggggcggtttggtatccatccgctgctccctccagcgcggctcttcccaacctcctgatcctgtcccctgcctgggtccccagccgcccgcccgtccctatattatagcaacgccagaaatgtggtggtggtggtcgccacgttagggtccgcgggggtcctcctgaggcagcctggtgccaacccgcaggcccaggctggggctcgtcatggccccgcccacctctgggtcggaactaaggtgggcctgagaggggggcgtcgagcactttcgcgccgtatccctccgccccccttcccgacaccctcgcggagagagcggttcttgcagcatcctgcgcagcccctgcccagtttggtgcagaggcgtggggggcgggacgcgtctttgccattctgatagcggggaaagcggtgagaatcgaagtgaggagccgccagaggagagctgaggagaggagggggaggtcgacgacctgggccctgggcctctgaaggcaagtgggggtgcgtgagcttggggtggtccgccagggtggaccggctggcagcctgccccgccgaccctgacatcctggcaaggaggagacgatccggtcggagccggtcgccggagagaggtgcgcagtgctcgagacccctggcgatggggaggcggtgaccggtgcaggccgagccaggccaagggctgaggggctggcttgagaggcaccgtcagatcgtctggaggagaaccgcgctgaccgcctccaagccagctttgcaggcgccggcgccccgccctcgacggtgtctgtgcccggaaagggctgtgggggagctcctgcgggagaaatggcggagcgggagccattgtggggggctcccgggaaggccggggggagccggcgtcccagctctgtgcccagcccacgagaggtgggccgcgttcgctactcggggccctgattccggaaaggggcctgtgggaccccgtgtcttgggtgctgtcccttcccacaggctccaggtggttgttaaagtctcctgtctgcgtgataggtctgttgggttctccaaaagtggaactttgagtgggtgaattatgaagacactaaaatgaaatgtttaaccgccttttataataccgcactgttttattgccttacatatttagatccccacatccagttttgtgcaagcaaatagggtgtggacttagtcgaatttcacaacagtggtccatgtaaataacagggtagtatttttccacctttcttgttcaggatctgttttctcaacatgctgatccactttaagtaatgtaatgatgtgtgagaatgtgggttccgagtagaggggtaatctttttgaagggtcaatttagaacatttgaagtcaatctgcttcttcagtttatggttctggaaaccaaaactccatctccagccactcctcacagaccctctcattttggtgcagaaatagtcccacagaagaattcatggcatttctgatggtggatatctgaggagctatgagagttgggagactttatttacttagtttctgattctcaaaaaggaggtgttagaatccgaattctgggaatctgtccattaacctgctatttttctaccattgttaacatagtctcttggggttattttttgctagttgctccgccttctttttgtagggcgtgactcttctttggtgggaaggatagcatctcctgagaactcctgctgtataagcaggctgacataggtggtgaataaagtaggatctaggtatgcatggggaaggggaaggacatgcacagatggtattaaaataacagtctccattatgttccctgcctgccttgtaagtacaattgcctatgttccactacctatttctgcacctcattttttttggttcaggaaaggagctgtaacttctattgggaaaatgactgacttcaaagttggcaggaggtgtaatcaggctgcaggtcttggggtgattagggaatcattgaggaagagcagacaggtgggagacatttaacatagccttgaatattcaaaagcatatgttataatccttgttataggcattagatcatcttagtctcttctgttttctttcctctgccttcctttctatccttaggtctgtttctttctaggttcctgtagagatctgtatgtagctgttcacttggaagttaattaagaaagaacaaaaactattcatttggattcaaggtaggtttatgtgtgagcacccccgttgattggggttatggaaaggctgttgccaagtgggttagaccagatcatatcttggtgccactgtcttccatctttctagtcacctctgacctcacatttgtgtacaagtgatggggtggggtgagccaggattatgcctatgaggtaattggtagatattggggcaggaaatgggaagataagccacaaggagtactaggaggccagaagtgttatataaccaaagccctagatttggaaaggcagaaattgggtttagagattagagtgtaggtctgtcaaccaaatactcagaactccaatcccatctgtatttttgtccataggcctgcccatgagttaactatagggcatatcaacactgcaaacagggaaggaggaaaaattgcactagatcagtgcaggttggtgtgagtgctgcctgaatacacctatgaggtctagtggtatatattttagtggtggacctactagcatgggtccaaagagactgggcactcctttagcctttctcactctcagcaagcttacctgccatctttgttcctgtttgatgcagagtaaaagaatgacagtgcttgggcaggacattgttgagcattagtggcagtgtgcaaggtataaaattaagtagcagagttttttattaatccacttctacacaattcatttctactctcctatgtccttctgtgtggctgtttgcatagagaagcacagttagacaagactcaaagccagtttctttcttcaacctcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaatttttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccacttatttaagtctcctttatttctctaagcagcattgtgtagttttcctgcaacatgcttttttagcagctgcatatattctgttatgtggtggtattacatgttatttaatctgttccctgatgatgaacacttacaggatttggtaagcatgaataattctatgatttggtatttaaatcttattctataggtgaggaagaccaaagttgtgatgggtaaagaagcagcagtcactaatattagccagaatgggggggggggtatttcatcatttttataattgggacaatgattttctgtgttaatacatgattacagagtagtcttgcttttgtcttgatacatgacattcatggagtagcctggtctgatgttaatgttctgtgaaattgtttcaattcaatgagagaacatcaaggcctagctgtgagtgctgggccagctcttagatgtcagactgcttttcttcttgtcatggatatttacaaatatttatgtatattgcctaaccttcaaaatgaatctcaccagcctcatctcatggatcatgaatgtctgtttcttcatatacttgccaacacttggtatcactgtttttaagttttgctactctcatagacaaaatcatctcattgttatttttataacaacattttaaaggttacataatactacatattatggatgtgacaattgaatcgcacctttatattccattgggttaattgtaggtatgtgaagatggaccccattacttagtgggtggaggagaggagtatatatacatctgtgtcactttgcctattttctttatgcctcctcattgctgtctttcccacgtgatctggaggcccttgcaattatcaccaactgacaactagaaaagttgtatcactttatgccttgggaactagatttaaaacaagaatgaagagtttagctgtgctgacattctgttacagagttcaggccctgaactctgttatggaccaacactcaggcaacagccatagtgactagacttgcaagtgatatgtacacacaactacacctcaaaacaaaatggggcttattaatgagacaagcaaaaatgctttccagttacagttttatgaagataacataaatgtacttctatttcttcagagttggtcattttataaaataagcttcagagaagtatcataattaattgtgagttgataaaagtcttcaagagcaacatgcactttttgctttaagattttagcttatctctggacacctactttcagctcgacagtgtgctatcttgtgtcagcagctcttctgaaaggagctctggccacctctctcctaaaggtgccatgtgcctctcaatggtcgttgctagggtttccctgaaggagaagagaactgcagaaacttgcaaactggaacagctatttgttgtgtatgttgaacacctcatttagcaaacaaaactaggctgttctcaggttgtgatatccaaaataaagcaaaatataaaagacttcggtagaaatatttttcttctccagaagatgttaatattccatgtaggagggagagactggctacaacctaaggcccagttaggtcctttgtggaaagctctaaaatgttaggaacaaacaaaatgcctagtatgttagcaatgaacaggaaagaggagtaatgcagaaagcaataatgtgtttccaggtgctctgctttgaattatgaaagagtgctattccctctccttgttgataacaaaatgtcattttaatgggaaattgcactggagaaagtgtgctccactaggcccatgctttattatgtagcttttatgtgtagctgtgctattgtagtttaaggatacaaagaattaatcttttatcagaaccatcttgattctacaaaatatgataatgtgatatgagttaaattgcactccttaacaaacatcgaatacttttttttttttttttgaggtggaatcttactctgtggcccaggctggaatgcaatggcatgatcccggctcactgcaacctccacctcctgggttcaggtgattctcctgccttggcctcccgagtacttgggattacagatgctcaccaccgcacccggctaatttttgtatttttagtagatatggggttttgccatgttgatcaggctggtctcgaactcctgaccttaggtgatcacccacctcggcctcccaaagtgctgggattacagacgtcagccactgcacccgacctacatgaatacttttataatggccttctggaaagccatacacttgggctgcaattgttcagaacattgaaattgcctttagaaccagtttgtattaattttatatttatgattgacacattataattgtgtatatttatgggtacagtatgatgtttcaatgcatgggtgcattgcataatgatcaaatcaggataattaccatatccatcactataaccacattcagaaccagtttgtgagttatacaaggacaccaggatcatcgctttatagccatggctatatattgaatatttttgtactcaagatcagtgctttttcatcttcatcatgtcctaacacactcagaaaaagagtatttgcatgggacaaacagacacatctgttcccccttaaaggcatcagcctcaaggactccagctgccccattcccacctgcaactactgtgagcactgagggaagcagtatcttcagcacacctgtaacctatttctagcatgtgattggaatgctctaccccaggtccatggttttcaactgcctttcttggagtcttaggattcccaggaaatgcttcaaaaggcactacagaggttcaggggaagctgagtgggttggatctatgtgcttcccactactctcaatcaaaacaacttagctttgggattatgtgtaagagtgtgtttggaaaaaagttccccctgttaaaaattgctgtgaccacttctataaatatccattcatccatccatctttaaaaagaatctgcatctaatggttgagttgcccttctgcatattcctaacactgacagtattactatctactgatttttttagttgatggaaatctattcatgttactcaaaagattcccgtgctcaggtttcacataatttattaaaagctctagctaataccttcaaataaagtttgtaaacttttgtaaattctatttttgaagaagtgtgtcacacacatggcagtcaggcaagagtaaatagtagttttgaatacaagtcccaaaggtatcatttttttattttgatgccagagttctcaacttcgttggcagtattttctgtctgccaaaagcataggcctccactgtacacatgtccatttgtgcaaaggttcccctaggaaacacttctagaatttgaatttctaagtctgaatagaacatttttcatcattggtgaaggtgtagaacagtgattcttaaccctggttgcattagaatcacctggagagcttttagaacctagtcatgcccaggatccgctcccaaagatgcttatttaattggtctggagaggaacttgggccttgataatttttaaaacgttccctaggtaatactaatgagcagtcaaatttgaaaaccgctgttgtagagaatcaggcaatctcatcaactgctggaggtaaaggagaataatttggtgtaacctcttctaatggtcatttaccaatatctattaaaatgttcatatttttgaatgagaaattaatagatatttatcctacagaaaaaaatacataaaagtgggcacaaatattgtataaatatgttaattgtaccaatgtttgtatttttgaaactagaaatattcaatatatccacaaataggagattaaatagcttacagtagttccgtagtatgggatattctgcattagtttaaagtaatcgaagagatctatatgtactaaaatatgatcttcgttttgaaaatgcatgaaaagagaaaaactggaatgacatataaaatatctaataggtttatagctagtggaggaactagagtgttttattatctttttatcttatttctctaattcttctttggtaaacaaatactacttatgtaataaaacatacaaccttaaggagaagatctgatgaggaagcatttgttacacaaaaagttgagcatatacccataaaggaaatatcaattaaatggagcttctcgggccgggtgtagtggctcacgcctgtaatcccagcactttggggggctgaggtggatcacttgaggccaggagtttgagaccagcttggcaacatagcaaaacccctttctactacaaatacaaaaattagccaggtgtggtagcgcatgactgtaatctcaaccactcaggtggctgaggcacgagaatcacttgaacccaggaggtggaggttccagtgagccaagatcgtgccactgcactccagcctaggcaacagagtgagactttcaaaataaaatgagataaatggaacttctgtaggggtgaattattggggcaagatacaaagtcgaatttcatgaacgcatattagtctaggaattacaaattatcgtaaatgagaagatgtaaatatgagctaaaattcacagtaatcgcccaagtaaatgagatatttaagcaatccagaaccttttctcatcaagttgattaagggaaataatctcccaaggtgttgggaggctgataggaaagtgtgtgtttcataatcagaacctaagaaatctgacacacaaactttgaaagtgtataagggaatgatcaaaaattagctgagtgtggtggtgggtgcctgtaatcccagctactcaggaggctgaggcaggagaacggcttgaacccaggaggtggaggttgcagtgagacaagatggtgccactgcactccaacctgggcaactccatctcgaagaagaaaatgtataagggaatgagaaacgttttgttttccggaggtcaagggaagtcgcagatcttggatggccgttacatatattattggcaatgcaaagagtcggtttacatccagacaccatactctcttttaaaaatgactgcatcaaataagtcttgtgaaaagcaaagaaaataataaaattgtgtttttatcttaaactagtaacagaagcaatcagttgctgaatggtctgtcactttatattcagtaggacctccctagacaggattattctgtgaagtagcatggttggaacaaaaagtagctaaggaagacatttcttctttttttccttttaatagacattctgtgcaccctttaacacaatatggttgcagcatcaaaggacacaattgattaatagtcatcataaaacttcacaaccatcctacaatgtgaaaaactgagcgcttagcctctactaaaggtttgtttattacatgaatgaaggaatgaacgaatgagctatgaggcactggatattgataaaaacaattctctatctttaaagtggaagttgagaagaaaacattagttccttgaacagccaactacctttgccaccagtaggtttagtcatacaaaaatctcttgaatggaatctatggtctttgagatatttcaaactgtgatagaaacaatgcaattaattcaagcaggtcctttctttaggactgatctacaaaatatgataatgtgatatgagtttaattgcactcctctacactataaaggacatctacactgatcaggcaaacctcacaattcaaatgaaccaattcaaactgcacatgtgagcttctcaaatgttttgtaggtataggctcaatagagggttgtttgctattaaatattggaaagtttacaaatttgtgttgggcagcattcaaagccatcctgggccacatgaggctgcgggtcacagattggacaagcttgctttaactcataatttgattttttaatgtttctctgatgcatgtgaaaatattatgagtaaaaagacaatgtttgggctctgctttaaaatactctagaaaacacacacacacacacacacacacaaacacacacacacaaaagggttggagagagttttaaaaatggcagaatgttactagatgttgcaacttgctggtgggcatatgggtgttcattaagctatcttttctacctttgtatatgctagaaattaaaattttaatccaaaaataaataaatattggaatcttaatatacaattttaatacttttatcatttgacatgtcctatgtaatatgctgtgaggatgaaaatacaactccattttcttttgaatatgtgttaaaaataataataaaaattatttttctttgcccagtgatttgaaaatgccacttttatcatcataaacatttataaatgctttggtcactctctcagtgggctttctattttatttcattaaattatatattgttatattggttttaattgttcttgccttgtaatttgttttagtataaaacagagaaagagtctcttcattatgcttcttctgaatggccatcattcttgttttattttattttatttattattcctgtttctaatggaagtaaggaagggtagagtgacttactcagtgttataaagtaagaatgttgttgatatagccccgggacccagatttcatgcctcccattacagtattctgtttgtcagcatcgttattttgctttattcttttgtgggatcttgtctctctgtaccttgaaggatataaccaacatcaagttctcttgcttctctgctgctgacagggaaaaaaaaaaaaggaagcaggaatgtacacacaccagttacatataaatgggtggtctttcatccctatctcaattatatcatcctaaacattctataatacaaaaatgatgcttaaggtaatatataatgtaatatgtgcttatttctctgtctgattcttaaaaaatttctgatgtatttaacagtcatgctgcaatctcaccagaattcttacactcagtcactacattcagttcaattagttaaacaaaaactcccagagtgtttggccctggctgaggctctacagatatatgttgctgtgtggtaggataccattgtggttaataccaatgtgctttgacaccatacagtctgggctagggtactgcctctgccccctactagccatgtggtcctggacaagtttcttaacctttctataccttgaggtcctgatccataaatggggataataccttaaagagctgttacgaagctcaaatacattaatgtcattaaagtactgaacatggtgtccagcatagaaatgtaggctagggtggaccttcatgctttttgttcatctgtcttgacgttgaaactccttttgggtctggctttacttgctgctcatataaccaatttctacatgttttaccatttaaaacatgcgtttaataaaggggaacaaaagctaagctctaaattttggttgaaactgcagattttgatacagtttataaaaacgactatacttcagtttgagaaactcatgtaaggatgaaaaaagactggagactctcaattctgtatgccatatgcatttatttaacaaatatgtatggaatgtctattatatgccaggctccagaagccctcaaaccatatctttattacagaaatttcttcaggggtccagacccatgaattcaaatacctatgagcaatttatatctaaagcagtgattcccattcaggagcaattatgctccttagctccagggacatggaaatgtctggagacatttttggtagtcacacctgggggtgctactggaatcttatgattagtggccaaggaggctgctgaacatcccccaatgcctaggacagcccccacagcaaagaactctccagcccaaaatgtcaatagtgctgaggttgagaaaacctgctctagaacagggcaaatgttactacccacacctatctgcaaaggttcatggtggaacccaaggttggggtctgaccaccctggattcaaataaccatgctgcctcttattgggcgtgtgtccttgtaaaatatatttaacctccattagccttaggagagcctgcttctggggaggaataagtttaagcagggaatattgatacctaacttacagaacagttgtaaggacttagagaaacagtatgtgaagtgcctaacacagtgtctggcccattgtaggcccttgaaatgttagttttctttccatccccctttctaacttctgcttctgagatgactttaacctaaactacatagtgctaagcagcataattgtgttctaaagagcttctgaaagcaaggcaacagaaagaaaaataaactcacacagacccacattatgtgtaagagttggtgcctcttctgtgttgtggcatcgtgcattgtaggtggcatggggaaatgtcaccccatttctttagaatcagtgtacctttcctgacctctttgggccccccttggagagtgaacatcaggagtggccattgactggttatctgggttgttcctgtggctccataaagacacatgcccagggaagagcagagcatgaggatgggtcttctggagagagcaatggagtgaaaggcagaagatgtcgcttccagagcctgacaaactgctttctgtgtgatgtgggtaaaacatataccttctcctggctacagacttggtgttagggcatgtgagttgaggggatcttctagcaggccaattttgggtataaatcatttggcttgtctctttccaagcatttctgccatcatataagttctcatattctagtgctgctgaaggattaaatgaattaaactatctcataggaaatctgggacattgctgaggcagaaggtcaaagtgtgctggtgggactcctagatggcccttatcacttctgcttgggaggggcacactccatttcccctcatagctcactggccacatctagtcacatgcccaggtctgatgtcagtggagtggggtcagtgggtgcctcagtgcacttgagctgccataacaaaatacctgaaagtgggtaatttgtaaacaacagaaatgtattactcaaagttctggaggctaggaagtccaagatcaagatgccagaatatttgtagtgtggtaaagactccgtctgcatcataaatgacaccttcttgctgcatgctcacatggtgaagtggcaaacaggttctctcaggcctctgataaggacactaatcccatttatgagggctctgccttcatggcctaactacctcctaaagattattaggtttcaacatataaatgtgtgggagacacaaacattcagacaaaagaagtgggcctaagagggaccctaaggacctgccggtacatgtaacttcacagctaggtttcatgggccagaaaacaagatttcatctccactatcatcttcctcaacatgaggggttattgagtgagtacctttaggggacaatactagggaaatgtaaaacttccaaatgggaagctgctggttttattgtggggagggaaagaatggaatcacattccatttctgccacttctctggagagggtcttagtccctttgagaaggagcttggtcatctgtgaaataagacgcaccacattatcttcttcagagtactgtcctgagggataaatgagaaaacctgtcaagtgcctatgggagatagtaggacttcagcacataacaggtctggctatttgccccctccctcccagagagtagatgacattgacctaaaccaaagggcattactgctattgagaccttgtggaaaggtagcagcaagagctgaaatatatccccataacctatgagctttgggccagttctgagttgtgggatgagttacatgtgagagctggggaaaaggaaaaataaatcaccataccatttcctataactgcatctgccttcctatcctcttaatttatcattcagtttgacactggaggagcagtttcccattaactttaaggtagaagggacaccacagggcaatatgacaagaatactggacggaagactagagtcataagaccagacacattatgatccacgattatgttctgttatatggcaaaagggagatgatcagcataggcctgacctaattagtcaagccctgtaaaatcagagaattttctcctgctgtttagagtagggcaagtcagagattcaaagcacaggaagccttcaatgtgccattgctggatggaagaaggaggccacatggcaggcaagtggactagcccccaggagctaagaatatccccaactgacagtcatcaaggaaatggggactgcggttcaatggccacaaggaaatgacttctgccagcagcaagaatgatcttggaagcagatttttatctagatcatccgcgtgagacctcagtggagccaacatgggcaccttgattctagctttgtgagaccttgagcagagaataaggtcatgctggaccagtcttctgacctacagacctgtgagctactagatggatgtagctttcagacactaagtctggttacacacctacaataaattaatacattccagttaagttaaatctattcaatgcatacacagtatttttgtttacatgtacacatgtgtatagatgataattggtggaaacataattacagtttttattagtgcatggtggggttagatattatcaatattcatattggtatttgaatgcactttccacattttttaaatagacagtgggttacttattaatcagagataaaacacattagagctttgttcatgtcaaatttgatagatttcagacttttcaaaaggtattgtaaatatgatagtaggcaaacacgtacacaaccaaggttatgaagcaaaacattacagagtggactctcctgtgtgagttccctgattgcctcagcgccctcagaaggaaccactatccaaaatttcttgtttagtcatgaatacatccctaaactaaacacataattgctttgcatatttttatctctatataagtaacatatttatatatctattatcgaaatgttttcttctgaaaatagtgtttctgagatgtttctaaccaggtgactttgggactattttgatatttacccatgctcctgtgaacaggtttgctatgtaccgagactctgcaatgcacatctgagagggcagcagatgacagagcctcacatgcttctattgtgggtgctgctcaatatctccacaaagaagttgtaccaatttgtccgctccaagctatgtatgggcttctcgtggccccaacatttcaattcaaacaggatgcaacataaacacaaattcgatgattgggttttcttttcaaactctagaattattccaagacatattctaaggtataatatggaaccattagctaagcatttttaatgcacctgtgaaatacactatttaaaacataatacgatagggaaaaataaagaaaatctaatgtaccaataacaggatctcagaataaaaaatattaaaaatctgtgaaacctatttttgcacagatcaggaaaaacagatgttttcaaattgttggatggaatataagaactattaaagaaattttaaagttcaactatataggaagcattaaaaatattaaatggtcatgctctttgacaaaacagttccacttctgggaatgtatcctcctgatatggcctcaagagtctcctgctgtaaccactcgtgtccacactgctcagggctgagatgaccatttccttagttggcccagtgccttcatgtcccagatcctgagtcatctacccctggatcaaaacaggaaaatcaaatctgaatcatggatggatgcccagactcgaaggaccatccactaattcaccacaaacattgatacagagcaatgctcaggtcccaactcctggagagatttgtagacctcaggcctcatccctgtctgggagaaatcttccttcctctcccatctttgtgtcctgagaggcccccacatccctaccaggtacaagcagcccggtcctttcaacaaattaagttttcataaaggatgaaagaaaaactggctccagaaggcttctgctgtcagccctctcacaaacctcccctgaagtaaggagagggggcaccaaccttactgcagggagggtaagcaaggagaacagagattaacctccttaacagtacatgtccagatacatttgctaaaggtctaccactagcaactcaaggtgcccaggctggcaggttctatccctggctctggcagtgggcctggtgagtaacctccttgccattcagctctgtgtttaggagcacgtgctttatagtcactgacatccatgaggaagagaggatactggtacctcaccagcacggctgtcatgagattaaatccagacactaatgtgaagaaactggagctgggcccagctaaaccatctgccttacaaaatagtagctgtcttttcctcctccaagcagggaactcatgttactctgagctgccacctcagccagggccccttaagagggcgcacatcgtagtcaccttgatgagtcttttctaaaccctcagctgaaactcccttgttggtggaaaaataggactttggcatcaaagatcattaatgtcttaagttataatatgagccttggaaaacagatatatccacttggcaccaacagtatatgtgagcgtctgctggcttttcattccaccaacaccaagtattaccaacttttgtccttattgccaatccaatctgctcattttccccagacctgtcccattggaagaatcagctcagatggtcattaaacttagagattcacagggtcatcccctgcaattgccagatttagcaaataataagacgatttaaaatttttattttgttatttatttcatttacttttatttatttaattaaaatccagttggattttaattttaaataaactaatattgcatgccacataaactaaaaaatattcctattaatccggaatttaaagttaactgagttgattttaatctggtaactgtacacgtggagggctctgtggagagccaagatgctcaggtcaacagccttaactgagctcccagcagacgccaacaccagtcatcattcatgtgagtgagctctctcagatgtcccagatgagtggaacctccagatgactgcagccccaggtgacagacatcatatagagcagaaaacatccagctgggcccagttaacacacaaaatactgagagaaaataaatggctattaattaagggtgcttgttaagaaggaacggatatctaaaacattatggttttggtgaacttttcctcattttctgtgttgtgttatcattgggtaagaaaggaattttcttatccttgaaggcttagtgaaacttggttataattgtatcatctgagtgttggcttacatgtgggtacagatttctgaacatgtcatcaattccttcttgaagggattcccaagggcaatttacatgatatctatttttcatgctagtcttaaaatttgaaacctaactccttaagaagaattcccactgcaatcatgtgaattaagatactgagagggcattgctacaaaccattctatgaggaaacctgagaggttgtcttagtgagtattcattctgaacaattttagaagtgtttctcaaagaaagtgtcctgaaacactttctcctgctatagtgataacccttggcaaggaagtaactttccttgggcacacatagacagggctcctttaggagacagcagatagatatacattgcagtccttggtctttatgactgtcccaatgcagcactgctgggtggataagtcaattctagaacttactcatagtaagcccacgtgacagcaaatctaagtcacattctccaatatcaccttataagagataaagtcaatatatgtttctccttattcttttcctatgtttctcagttggtttagagctcagactagaagcagaagagtattttgggggccccttaaagaattaagcattgtgaatcaagaactataggaataattgtagagtcagtgagacacagttagaggagtaaacctgtgggcctattttaagtcccatccctgaaggcaaagctgaacaagtgcctcctgaagggcagcttactaccaagaagttgaagggagagggcttgggcagagtatcatgtgtctccttccagattctccaatcggataagtcattcctgccgtagagaggagtgagtgtgtagaggctacatgtatttttgtcatggatgtattttccacatggaaaaacataccaggaatgaaggataagaatttccttaaggcagggctgggtgcggtggctcacgcctgtaatcccagcactttgggaggccgaggcgggtggatcacgaggtcaggagatcgaggccagcttgactaacatggtgaaaccctgtctctactaaaaatataaaaattagctgggtgtggtggtaagcgcctgtaatcccagctactcgggaggctgaggcaggagaatcgcttgaacctgggaggcagaggttgcagtgagctgagattgcgccgtgcactccaacctgggcgatagagcgagactccgtctcaaaaaaaaaaaaaaaaaaaaaaatttccttaaggcaaactactgtgtgttttaattgactggattcctgcctactaaatgattatattattctagtccggcctccctgaaataactgtattattactcaaatgacagtttttgtgtttctagatcattcagtcacttgattataaacaatctgttttctgccacagaaaaccaactgcctagtatagtgtgtgagttgtacatgttcctcctcagagggctagctcatctcccagagtcctaggacacctctctgggcttctgtgtactgatgatactcctctaaggtcacttttttttttttttttttttgagaatctcggctcactgcaagctccgcctcccgggttcacaccgttctactgcctcagtctcctgagtagctgggactacaggcgctcgccaccacgcccggctaattttttgtatttttagtagagatggggtttcaccgtgttagtcaggatggtgtcgatcttctgacctcgtgatcctcccgcctcgccctcccaaagtactgggattacaggcatgagccaccgcgcccggcccccttaggtcacttttaaagcaaaattcctgacaacatggacttcctttcctctaccataatgagtagagagtcttgaaaattgcccggatcccagcctctaattggtatgttttctcagggagttatctgaagaatgaaggtgttttgctttaagggataggctggggatggaggagcgggttgtgcatagtcattttcaggtgtggaagacaagccagtgctacgcggttgccatagtaacctgacgtcatattagcgacggtgacgactttttattgagaccaatttggcctggggagaaccgccttcaggcgtttggactcagtggaggttgtgagtgcccagcagtgtggcctgaatctccgtggggtttagggagacgaaaggaccccagatcgacgtcccctcgttcccactttggggatcggcgctctggctgtttcgtgaaggagagagaggtgggtctcttctggccccagtgagtgtggtgtcctgctccagggtgtcccggggctactttccctgtaaaggcgggacgcgggaggatgagacaggtaaagaccctctctgagcccagtttcccactctgtaaaatggaaataaaaatgctcacccacaggattgctgaaaccttcagtgataacataggtgcaagacgatagccctgtggttattgcaggatcaggaatgcctgtatgaagtcaggcctcttcttgttctgtttcaaactttcttacagtatagacaagggagaaactttatgtttaacatgcatttatgataagtttatatatatatttctgactgcataaataataaccagtgattcccatcaacactatcaaatgaatgttgaaatataaagttagttagaaggccttcctaccaatttgagattataatatgcattctcccatatctgttgtataataaatttgtttatgaactataacttataaagtgtcaattaaaaagtcatatgatgttttgatatattttatacattgtagaatggctgaatcaagctaataaacctatgcattacctaatgtacttttttttgtggtgaacacttaaaatctacccttttagcagttttcaagtgtacaatatatttttattaaccatggtcactatgatgtacaatagatcccttgaatttatccctcctctctaactgaaattttgtatccattgaccaacatctccccaaacccctccccagcctctgtctggtaattactgttctactctctgcttctatgagttcaacttatttagattccatatacaagtgagattacgtggtatttgtcttgctgtgcctggcttatttcacttaatgtcctccaggttcatccatgttgtcacaaatgacaggatttccttcttttttcaaaaagctgaatagtacgccattgtgtgcatgtatgacattttctttattcatctgttggtggatacttaggttgattccataccctggctattgtgaataatgctgcagtgaacatgggagtacatacatctgtttgaggtactaatttcatttcctttggatatatactcagaagggggactgctggatcatttggtaattctatttttagtttttttcaggaatgaccatactgtttctgtaatatctgtataaatttacattcccagtattgtacaagggttccatttttttccacatccttgtgaacacttaccatcttctgtttttttaaataatggccatcctaacaagtgtgaggtgatatcttgttatggttttaatgtgcatttccctgacaattagtgatattgagaattttttcacatatctgttggccacttgtatgtcttactttgaaaaatgtatattttattatatatggacacatgattattgtacatatttatgggggtacactgtgatatttcaatatatgtatacaatgtgtagtgataaaatcagggtagttagcatatccatcatctcaaatctttatcatttatatgtgctggtaacattcaacattttctcttctagctatttgaaaaaatacattaaattattgtttgataatttagtataatgctatagaacactagagattattcttcctatccagggtctggagtatgggctagccttcaatggatgttaatctagtgtctggagtacagacatgtgcaaagtgaccttggcttaggggcccggatcccagcctagttcctctaattggtatgttttctcagggagttatctgaagagtgaaggtgttttgctaggtctctatggcagtggctctggtgtctgaggcatgggcaggcacagtcaggcacagagctggggtctggagtatgggtatttacagagtagttgtagcttgggggggtcagtgacacatgcagcattgggacaggtggcacctctggtcccagagtggtataatagctgctgcttcttgagatgagaagtgtgtagccacttctccctctctggggttccttgggcaggaatggctgttggttatctcagtggcgaaagatgccagtgtcctctccagagcagactgctggggaccatggtgattcctgccacatggctaatagcaatagcctttgcctttcttctttgctcctagacatctcctggcacctcaagtatactgatctcaccagcaatattttctgtgtggatattccccatttttttttctactgtgttgctgcagattcttaaatgggcccctgagccctcccatgaatactttagtttgtggatagctgtctacacttgtttttttgtggcagggggtgatgaaggctgatatctcctactctgccctcttggtccttcagtatctagtttgccctattctaatgataccctgccatgtcccctaaaggaaccgtataggcttatatatcattgttattattttcaaggacataacattttcagttctgttgtacccagcctacccattcctcccactgtcctgtctccagacaaatacagcacttttgtcattatagattagatttcatttatttaaaaataatcatagaggttttttttttattttttttttttagggatctggcttctttcattcactctatgtatttttagatttgtccattttattgcctatttcaatagtttttttttttttattacagagtagcattacagtataggatatactacaattcgttttgtccattcacttgctaatggatatttgggttgtattcaatttaggggatcttgtgtatgagtctttacagagaaatgtgctttctttctctagggtaaatacttaggattgcagtggctggaacatgttatagatgtaagactaacattgtaagaaactgccaaactgttttcaaagtggttgtaccatttttcattgtctcagcagagcttcatcctccacaacctcgtcagtgcttggtatggtcagtctctaactttagtgattctcatgcggcgataaaacaagacgacccaatggagcttaattaggccacacacaaaaaacattaactatttaaaggaataatatttaatctactgggctaaaaatttcagttggggtaacttcagagcaccgtacaacctctgaatgattaaaacccggactagactagttattcataaaagtgtgttataatttattgacccaagcaatttgatcaatagaacaagttaccctagggataacagcatgatcatatcttagagttcatatcaaccatagggatttacaatcctgatgtgggatcagaacatctcaatagtataacagctattttttttttttttttttttgagacgaagtctcgccccgtcgcccaggctggagtgcagtggtgcaatctcggctcactgcaacctctgcctcccaggttcaagcgattctcttgcctcggcctcccgagtagctgggactacaggcgcccgccacctcgcctggctgattttttgaatttttagtagagacggggtttcaccgtgttagtcaggatggtctggatctcctgaccttgtgatccgcccgcctcagcctcccaaagtgctgggattacagacgtgagccaccgcgcctggccagcagctattaattgtttatgttttcagtgaccaaagtcctacatgatttaagttcaggatctgggttggtttccacctatttaatatttctcccaatacaaaaagagaagagaattatggcacacaaaaagcaccctcaattcaaaagatgatataatctagatctaatttattattatacactttgccccaaaacagggcttgttaagatggtagagcctggtaattgcataaaacttgaaattttataatcagaggttcaattactcttctttttaaaataattgtttattttatttttattttttgtgggtatacagtaggtgtatgtatttatggggtacatgggacgttttgatacaggcatgtaatgcatatcaatcacatcgtggaaaatgggtatctcctcaagaatttatcctttctgttacaaaaaaatccaattatactcttttagttgttttaaaatatacaattaagttattattgactatagtcaccctgttgtgctatcaaatactaggtccgtttcattctattttttgtactggttaaccatcccccatctctccccaaccctccccaattcctttcccagcctctggtaaccatccttctactctctatctccacaggttaaattgttttgatttttagaccccacaaataaataagaacatgcaaggtttctccttctatgtctggcttacttcacttaacataatgatcgccagttccatccatgtttttgcaaatgactggatctcattattttttatggctgagtagtactccatcgtgtataagtaccacattttctttatccattcatctgttgatggacacaggcttcttccaactcttgtctattgtgaacagagtggcaacaaacatgggagtgcagatgtctcttcaatatactgatttcctttcttttgggtatatatccagagtaggattgctggatcacatgggtagctctattttcagttttctgaggaacctccaaactgttctctacaatggttgtagtaatttacgttcccaccaacagtgtacgagggttcttttttctccacatcttcacctgcaattgttattgcccgtcttttggacataagccattttaactgagaagggatgatatctcattgtagttttgatttgcatttctctgatgattcattacgttgagcacctatatatgcctgtttgtcatttgtatgtcttcctttgagaaatgtctattcagatatatatatatatttttttttttttttttttttttagacggagtcttgctctgtcagcaggctggagtgcagtggcgcaatctcggctcactgcaacctccacctcctgggttcaagcgattctcctgcctcagcctcccgagtagctgggactacaggcgcatgccaccatgcccagctaatttttgtatttttagtagagatggggtttcaccattttggccaggatggtctcgatctcttgacctcgtgatccacccaccttggcctcccaaggtactgggattacaggcatgagccaccgtgcccggcctgcccattttaaattcagattattatattttttcctatagaactatttgagatacttatacatctggttattaattccttgtcagatgggtagtttgcaaacatttttacccattctgtggttgtttcttaactttgttgattgtttcctctgctgtgcagaagccttttaacttgatgtgatgctatttgtccatttttgctctggttgcctgtgcttgtggggtattactcaagaaatttttgcccagactgatgttctggagagttttcccaaagttttcttgtagtagttttatagtttgaggtcttagatttaattctttaatccattttgatttgatttttgtacatgatgagagataggggtctagtttcattcttctgcatataggtatccagttttcccaggaccatttattgaaggtactgtctttacagtatatgttcttggcacctttatcaaaaatgatttcactgtaggcgtatgcatttctttccgggatctctattctgttccattcatctatgtgtctgtttttatgacagtagtatgctgttttggttactatagctctgcagtataatttgaagtcaggtaatgtgattcctccacttttattcttattgctcaggatcgctttagctattctgggtcttttgtggttctatatcccttttagggtactttttttctatttctatgaagattgtcattggtattttgataggaattgcattgaatctgtagattgctttgggtagtatgggcattttaacaatattgatttttccagtgcctgaacgagggatatttttccatcttctggtgtccccttcaatttatttcatcagtcctttgtggttttcattatagaggtctttcacttctttggttaattcctaggtattttatttcgtttgtggctattgtaaatgggattacatttttattttttttttcagattgctcactgttggcatatagaaatgctactgatttttccatgttgattttgtatcctgcaactttactgaatttatttattagtatgaatagttttttggtggagtctaggtttttccaaatataagataatgtcatctgcaaacaaggatgattttaattcttcctttccaacttggaggcactttatagctttctcttctttggatgctctagctaagagctccagtactgtattaaataacagtggtgaaagtggccggccatattatgttccagatcttagagaaaaggctttcaattttttttcccattcagtatgatactagctgtgggtctgtcaatatgggttttattatgttgaggtatgttccttctaccccagttttttagggtttttatcaagaaagagatgttgaattttatcaaatgcttttccagcatcaattgaaatgatcatatggtttttgtctttctgttgacatgatatatcacattgattgatttgcatatgttaaactgtccttgcatcccaaagataaatcccacttggtcatgatgaatgatctttttgatgtatcattgaattgggttttgctggtattttgctgaagatttttgcatcaatattcatcatagaaattggcctatagtttttttttagtgtgtttttgtctggttttggtatcaaaataatactgtcctcatagaatgagtttggcagtattccttccttctgttttttggaatagtttgagtaggatttgggtattagttctctttaaatgtttggtagaatttagcagtaaagccatggggtcctggactttttcgttactgggtgtattagtctgttttcacactgctgataaagacataccccagactgagactgggcaatttacaaaagaaagaggtttaattggacttaacagttccacatggctggggaaacctcacaataatggtggaaggcaaggagatacaagtcacaccttatatgaatggcagcaggcaaacagagagagagagcttgtgcagagaaactcccatctttaaaaccatcagatctcatgagaccggttcactatgacaagaacagcatgagaaagacctatccccataattcaaacatcttcccccaggtccctcgcacaacatgtgggaattatgggagctacaagatgagatttgcgtggggacaaagagccaaaccgttatcactggggagactttttactatggctttaatctcattacttgtttttttctttttttttttttactttaagttttagggtacatgtgcacaacgtgcagattagttacatatgtatacatgtgccatgttggtgtgctgcacccattaattcgtcatttaacattaggtatatctcataatgctatccctcccccctccccccagcccacaacaggccccggtgtgtgatgttccccttcctgtgtccatgtgttctcattgttcaattcccacctatgagtgagaacatgcggtgtttggttttttgtccttgtgatagtttgctgagaatgatggtttccagcttcacccatgtccctgcaaaggacatgaactcatcattttttgtggctgcatagtaatccatggtgtatatgtgccacattttcttttttttttttttttttttgagacggagtctcgctctgtcgcccaggccagactgcggactgcagtggcgcaatctcggctcactgcaagctccgcttctcgggttcacgccattctcctgcctcagcctcccgagtagctgggactacaggcacccgccaccgcgcccggctaattttttgtatttttagtagagacagggtttcaccttgttagccaggatggtctcgatctcctgacctcatgatccacccgcctcggcctcccaaagtgctgggattacaggcgtgagacaccgcgcccggccgccacattttcttaatccagtctatcattgttggacatttgggttggctccaagtcttcgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttctgagaagtgtctattcatatcctttgcccactttttgatggggttgtttgtttttttcttgtaaatttatttgaattcattgtaggttctggatattagccctttgtcagatgagtagattgcaaaaattttctcccattctgtaggttgccttttcactctgatggtagtttcttttgctgtgcagaagctctttagtttaattagatcccatttgtcaattttggcttttgttgccactgcttttggtgttttagacatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttttacatgtggctagccagttttcccaatgccatttattaaatagggaatcatttccccatttcttgtttttgtcaggtttgtcaaagatcagatggttatagatatgtggcattatttctgagggctctgttgtgttccattggtctatatctctgttttggtaccagtaccatgctgttttggttactgtagccttgtagtatagtttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggtcattctcatgatattgattcttcctacccatgagcatggaatgttcttccatttgtttgtatcctcttatttcattgagcagtgatttgtagttctccttgaagaggtccttcacgttccttgtaagttggattcctaggtattttattctctttgaagcaattgtgaatgggagttcactcatgatttggctctctgtttgtctgttattggtgtataagaatgcttgtgatttttgcacattgattttgtatactgagactttgctgaagttgcctatcagcttatggagatttttgggctgagatgatggggttttctagatatacaatcatgtcatctgcaaacagggacaatttgacttcctcttttcctaattgaataccctttatttccttctcctgcctgattgccctggtcagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctagtttattgagagtttttagtatgaaggttgttgaatttagtcaaaggccttttctgcatctattgagataatcatgtggtttttgtcattggttctgtttatatgctggattacgtttattgatttgtgtatgttgaaccaggcttgcatcccagggatgaagcccacttgatcatggtggataagctttttgatgagctgctggatttggtttgccagtattttattgaggatttttgcatcgatgttcatcagggatattggtctagaattctctttttttgttgtgtctctgccaggctttggtatcaggatgatgctgtcctcataaaatgagttagggaggattccctctttttctattgattggaatagtttcagaaggaatggtaccagctcctccttgtacctctggtagaattcggctgtgaatccttctggtcctggacttttttggttggtaagctatcaattattgcctcaatttcagagcctgttattggtctattcagagattcaacttcttcctggtttagtcttgggagggtgtatgtgtcaaggaattcatccatttcttctagattttctagtttatttcatagagttgtttatagtattctctggtgatagtttgtatttctgtgggatcggtggtgatatcccctttatcattttttattgtgtccatttgattcttctctcttttcttctttattagtcttgctagcggtctatcaattttgttgatcttttcaaaaaaccagcgactggattcattaattttttgaagggttttttgtgtctctatttccttcagttctgctctgatcttagttatttcttgccttctgctagcttttgaatgtgtttgctcttgcttctctagttcttttaattatgatgttagggtgtcaattttagatctttcctgctttctcttgtgggcatgtagtgctataaatttccctctacacactgctttgaatgtgtcccagagattctggtatgttgtgtctttgttcttgttggtttcaaagaacatctttatttctgccttcatttcgttatgtacctagtagtcattcaggagtaggttgttcagtttccatgtagttgagtggtttcgagtgaatttcttaatcctgagttctagtttgattgcactgtggtctgagagacagtttgttataatttctattcttttacatttgctgaggagtgctttacttccaactatgtggtcagttttggaatgagtgtggtgtggtgctgaaaagaatgtatattctgttgatttggggtagagagttctgtagatgtctattaggtccacttggtgcagagctgagttcaattcctggatatccttgtgaactgtctgtctcgttgatctgcctaatgttgacagtggggtgttaaagtctcccattattattgtgtgggagtctaagtctctttgtaggtcactaaggacttgctttatgaatctggctgctcctgtattgggtgcatatatatttaggatagttagctcttcttgttgaattgatccctttaccgttatgtaatggccttcattgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttttgtgtgaatttgatcctgtcattatgacgttagctggttattttgcttgttagttgatgcagtttcttcctagcctcgatggtctttacaatttggcatgtttttgcagtggctggtaccggttgttcctttccatgtttagtgcttccttcaggagctcttttagggcaggcctggtggtgacaaaatctcccagcatttgctcgtctgtaaagtattttatttttcctttacttatgaagcttagtttggctggatatgacattctgggttgaaaattcttttctttaagaatgttgaatattggctcccactctcttctggcttgtagagtttctgcagagaaatcagctgttagtctgatgggcttccctttgtgggcaacccaccgtttctctctctctgcccttaacattttttccttcatttcaactttggtgtatctgacaattatgtgtcttggagttgctcttctcaaggagtatctttgtggcattctctgtatttcctgaatttgaatgttggcctgccttgctagattggggaagttctcctggataatatcctgcagagtgttttccaacttggttccatcctccccgtcactttcaggcacaccaatcagacgtagatttggtcttttcacatagtcccacgtttcttggaggctttgttcgtttttttttattcttttttctgtaaacttctcttctcgcttcatttcattcatttagtcttccatcactgataccctttcttccagttgatcgaattggctactgagacttgtgcattcatcacgtagttcttgtgccttggttttcagctccatcaggtcctttaaggacttctctgcattggttattgtagttagccattcatctaattttctttcaaggtttttaacttctttgtcatgggttcgaactt

SEQ ID NO: 12672 - DNA, 6037 bp, Homo sapiens
agctattttattattattattattattattattatttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccctccccaccacagtccccagaatgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcgtagtattccatggtgtatatgtgccacattttcttaatccagtctatcattgttggacatttgggttggttccaagtctttgctattgtgaataatgccgcaataaacatacgtgtgcatgtgtctttatagcagcatgatttctagtcatttgggtatatacccagtaatgggatggctgggtcaaatggtatttctagttctagatccctgagaaatcgccacactgacttccacaatggttgaactagtttacagtctcaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtacaaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctgtgttcttttggcttaggattgacttggcgatgcgggctcttttttggttccatatgaactttaaagtagttttttccaattctgtgaggaaagtcattggtagcttgatggggatggcattgaatctgtaaattatcttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagaggtcatccctgtcttgtgccagttttcaaagggaatgcttccagtttttgcccattcagtatgatattggctgtgggtttgtcatagatagctcttattattttgaaatacgtcccatcaatacctactttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattaatcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttcctgaggagagctttacttccaactatgtggtcagttttggaataggtatggtgtggtgctgaaaaaaatgtatattctgttgatttggggtggagagttctgtagatgtctattaggtccgcttggtgcagagctgagttcaattcctgggtatcctttttgactttctgtctcgttcatctgtctaatgttgacagtggggtgttaaagtctcccattattaatgtgtaggagtctaagtctctttgtaggtcactcaggtcttgctttatgaatctgggtgctcctgtattgggtgcatatatatttaggatagttagctcctcttgttgaattgatccctttaccattatataatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgccacggctgttaccggttgttcctttccatgtttagcgcttccttcaggagctcttttagggcaggcctggtggtgacaaaatctctcagcatttgcttgtctgtaaagtattttatttatccttcacttatgaagcttagtttggctggatatgaaattctgggttgaaaattcttttctttaagaatgttgaatattggcccccactctcttctggcttgtagggtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgtcggcctgccttgctagattggggaagttctcctggataatatcctgcacagtgttttccaacttggttccattctccgcatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcatcaaaatcattctccatccagctttgttccattgctggtgaggaactgcgttcctttggaggaggagaggcgctctgcgttttagagtttccagtttttctgttctgttttttccccatctttgtggttttatctacttttggtctttgttgatggtgatgtacagatgggttttcggtgtggatgtcctttctgtttgttagttttccttctaacagacaggaccctcagctgcaggtcttttggaatactctgctgtgtgaggtgtcagtgtgcccctgctggggggtgcctcccagttaggctgctcgggggtcaggggtcagggacccacttgaggaagcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcttccttgagctgtggtgggctccacccagttcgagcttcctggctgctttgtttacctaagcaagcctgggcaatggcgggcgcccctcccccagcctctctgccgccttgcagtttgatctcagactgctgtgctagcaatcagcgagattccgtgggcttaggaccctccgagccaggtgtgggatataatctcgtggtgcgctgttttttaagccggtctgaaaagcacaatattcgccaggtgcgtccgtcacccctttctttgactcggaaagggaactccctgaccccttgtgcttcccaggtgaggcaatgcctcgccctgcttcggctcgcgcacggtgcgcgcacccactggcctgcgcccactgtctggcactcccttagtgagatgaacccggtacctcagatggaaatgcagaaatcacccgtcttctgcgtcgctcacgctgggagctgtagaccggagctgttcctattcggccatcttggctcct

SEQ ID NO: 12673 - DNA, 6075 bp, Homo sapiens
tttctcttttttttttttttttttgaattgtgttggcttttttttttttttttttattatactctaagttttagggtacatgttcacattgtgcaggttagttacatatgtatacatgtgccatgctggtgcgctgcacccactaacgtgtcatctagcattaggtatatctcccaatgctatccctcacccctcccccgaccccaccacagtccccagagtgtgatattccccttcctgtgtccatgtgatctcattgtttaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatgcctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctccttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctggtctgttccattgatctatatctctgttttggtaccagtaccatgctgttttggttactgtagccttgtagtatagtttgaagtcaggtagtgtgatgcctccagctttgttcttttgtcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtcagagagggcatccctgtcttgtgccagttttcaaagggaatgcttccagttattgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcccggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgttcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatctaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggagtcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcacactgtctggcactccctagtgagatgaacccggtacctcagatggaaatgcagaaatcacccgtcttctgcgtcgctcacgctgggagctgtagaccggagctgttcctattcggccatcttggctcctcccctgt

SEQ ID NO: 12674 - DNA, 5479 bp, Homo sapiens
tttttttttaaatcaattgacaatgatttttattaatttctttctttattattattattatactttaagttttaggtacatgtgcacaacgtgcaggtttgttacatatgtacacatgtaccatgttggtgtgctgcacccattaactcgtcatttagcattaggtatatctcctaatgctatccctcccccctccccccaccccacaacagtccccggtgtgtgatgttccccttcctatgtccgtgtgttctctttgctcaattcccacctatgagtgagaacatgtggtgtttggttttttgtcctagcgatagtttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgtcgcaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttttttgtgtgttttttggctgcataaatgtcttcttttgggaagtgtctgttcatatccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagagtttttatggttttaggtctaacatgtaagtctttaatcaatcttgaattaatttttgtataaggtgtaaggaagggatccagtttcagctttctacatatggctagtgagttttcccagcaccgtttattaaatagggaatcttttccccattgcttgtttttgtcaggtttgtcaaagatcagatagttgtagatatgcagtattatttctgagggttctgttctgttccattggtctatatctctgttttggtaccagtaccatgctgtttttgttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgctcttccacttgtttgtatcctcttttatttcattgagcagtggtttgtagttctccttgaagaggaccttcacatcccttgtaagttggattcctaggtattttattctctttgaagcaattgtgaatgggagttcactcatgatttggctccctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaagagggactatttgacttcctcttttcctaattgaatgccctttatttccttctcctgcctgattgctctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcagtacctaatttattgagagtttttagcatgaaggttgttgaattttgtcaaaggccttttctgcatctattgagataatcatgtggtttttgtctttagttctgtttatatgctggattacttttattgatttgtggatgttgaaccagccttgcatcccagggatgaagcccacttgatcatggtggataagctttttgatgtgttactggattcggtttggcagtattttattgaggatttttgcacgccattgcatcaattggtctaaaattctctttttttgttgtgtttccgccaggctttgttatcaggatgatgctggcctcataaaatgagttagggaggagtccctctttttctattgattggaataatttcagaaggaatggtaccaattcctccttgtacctctggtagaattcggctgtgaatccatctggtcctggactttctttggttggtaagctattaattattgcctcaatttcagagcctgttgttggtctgttcagagatttaacttcttcctggtttagtcttgggagagtgcatgtgtcgaggaatttatccatttcttctagattttctagtttatttgcgtagaggtgtttatagtattctctgatggtagtttgtatttctgtgggatcggtggtgatatcccctttgtcattttttattgcgtctatttgatccttctctcttttcttctttattagtcttgctagcggtctatcaattttgttgatcttttcaaaaaaccagctcctagattcattaattttttgaagggttttttgtgtctctatttccttcagttctgctctgatcttagttatttcttgccttctgctagcttttgaatgtgtttgctcttgcttctctagttcttttaattgtgttgttagggtgtcaattttagatctttcctgctttctcttgtgggcatttagtgctataaatttccctctacacactgctttgaatgtgtcccagagattctggtatgttgtgtctttgttttcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactgtgtggtcaattttggaataggtgtggtgtggtgctgaaaagaatgcatattctgttgatttggggtggagagttctgtagatgtctattaggtccacttggtgcagagttgagttcaattcctggatatccttgttaactttttgtcttgttaatctgtctaatgttgacagtttggtgttaaagtctcccattattattttgtgggagtctaactctctttgtaggtcactcaggacttgctttatgaaactgggtgctcctgtattgggtgcatatatatttaagatagttagctcttcttgttgaattgatccctttaccattatgtaatggccttctttgtctcttttggtctttgctggtttaaactctgttttatcagagactaggattgcaacccctgcctttttttgttttccatttgcttggtagatcttccttcatccctttattttgagcctatgtgtgtctctgcacgtgagatgggtttcctgaatacagcacactggtgggtcttgactctttatctaatttgccagtctgtgccttttaattggagcatttagcccatttacatttaaggttagtattgttatgtgtgaatttgatcctatcattatgatgttagctggttattttgctcgttagttgatgcagtttcttcctagccttgatggtctttacaatttggcatgtttttccagtggctggtatgggttgttcctttccatgtttagtgcttccttcaggagctcttttagggcaggcctggtggtgacaaaatctctcagcatttgcttgtctgtaaagtattttatttctccttcatttatgaagcttagtttggccagatatgaaattctgggttgaaaattcttttctttaagaatgttgaatattggcccccactctcttctggcttgtagagtttctgtggagagatcagctgttagtctgttgggcttccctttgcaggtaacccgacctttctctctggctgcccttaacattttttccttcctttcaactttggtgaatctgacaattatgtgtcttggagttgctcttctcgaggagtattgttgtggtgttctctgtatatcctgaatttgaatgttggcctgccttgctagattggggaagttctcctggattatatcctgcagagtgttttccaacttggttccattctccatgtcactttcaggtacaccaattagaggtagatttggtcttttcacatagtcccatatttcttggaggctttgttcatttctttttattcttttttctctaaacttctcttcacgcttcatttcattcatttcgtcttccatcactgataccatttcttccagttcattgcatcagttactgaggcttgtgcattcatcacgtagttctcttgccatggttttcagctccatcaggtcctttaaggacttctgtgcattggttattctagctatccattcgtctaattttttttcaaagtttttaacttctttgccattggttcgaacttcctcctttagctcggagtagtttgatcttctgaagccttcctctctcaactcgtcaaagtcattctccgtccagctttgttccattgctggtgaggagctgcgttcctttggtggaggagaggcgctctgatttttagagtttctggtttttctgctctgttttttccccagctttgtggttttatctacctttggtctttgatgatggtgatgtacagatgggtttttggtgtggatctcctttctgtttgttagttttccttctaacagacaggaccctcagctgcaggtctgttggagtttactggaggtccactccagaccctgtttgcctgggtatcagcagtggtggctgtagaagagtggatataggtgagctgcaaatgctgctgcctgatcgttcctctggaagttttgtctcagaggagtacctggccggccgtgtgaggtgtcagtccgcccctactggtgggtgcctcccagttagg

SEQ ID NO: 12675 - DNA, 4840 bp, Homo sapiens
cagtagtcttttttttatttttttttcgttactagaagttttagggtacatgtgcacaacgtgctggtttgttacatatgtatacatgtgccatgttggtgtgctgcacccattaactcttcatttaacattaggtatatctcctaatgctatccctccccccttccccaaccccaaaacaggtcccagtgtgtgatgttccccttcctgtgtccatgtgttctcactgttcaattcccacctatgagtgagaacatgcagtgtttggttttttctcattgcaatagtttgctgagaatgatggtttccagcttcatccatgtccctacaaaggacatgaactcatcattttttatggctgcatagtattccatggtgtatatgtgccacattttcttaatccagtctatcattcttggacatttgggttagttccaagtctttgctattgtgaatagtgctgcaataaacatacgtgggcatgtgtctttatagcagcatattttataatcctttgagtatatacccagtaatgggattgctgggacaaatggtatttctagttctagattcctgaggaatcgccacactgacttccacaatggttgaactagtttccagtcccaccaacagtgtaaaagtcttcctatttctccacattctctccagcacctgttgtttcctgactttttaatgatcgccattctaactggtgtgagatgatatctcattgtggttatgatttgcatttctctgatagccagtgatgatgagcattttttcatgtgtcttttggctgcataagtgtcttcttatgagaagtgtctgttcatatccttcacccacttgttgatggggttgtttgttttttcttgtaatttgtttgagttcatgtcgattctggatattagccctttgtcagatgagtagactgcaaaacttttctcccattctgtaggtgcctgttcactctgatggtagtttcttttgctgtgcagaagctcttgagttttattagatcccatttgtcaattttggcttttcttgccattgcttttggtgttttagtcatgaagtccttgcccatacctatctcctgaatggtatggcctaggttttcttctagggtttttatggttttacgactaacatttaagtctttcatccatcttgaattaatttttgtataaggtgtaaggaagggatccagtttcagcttcctacatatggctggccagttttcccagcaccatttattaaatagtgaatcctttccccatttcttgtttttgtcaggtttgtcaaagatcagatagttgtagatatgtggcattatttctgagggctctgttctgttccatttgtctatatctctgttttggtaccagtaccatgctgttttggttactgtacgcttgtagtatagtttgacctcaggtagcatgatgcctccagctttgttcttttggcttaggattgacttgggaatgcaggctcttttttcattgcatatgaactttaaagtagatttttccaattctgcgaagaaagtaattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagagttccttcacatcccttgtaagttggattcctaggtattttattccctttgaagcaactgtgaatgggagttcactcatgaactggctctctgtttctctgttattggtgtacaagaatgcttgtgatttttgcacattgattttgtatcctgagagtttgctgaagtttcctatcagcttaaggagattttgggctgagtcaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagcgaatgcttccagtttttgcccattcagtgtgatattggctgtgggtttgtcatagatagctcttattattttgagatatgtccaatcaatacctaatttattgagagtttttagcatgaagtgttgttgaattttgtcaaaggccttttctgcatctattgagataatctaatcatgtgttttttgtcattggttctgtttatatgctggattgcatttattgatttgcgtatgttgaaccagccttgcatcccagggttgaagcccacttgatcatggtggataagctttttgatgtgctgctggattcggtttgccagtattttattgaggatttttgcatcaatgttcatcaaggatattggtctaaaattctctttttttgtggtgtctcagccaggctttggtatcaggatgatgctggcctcataaaatgagttacggaggattccctctttttctattggttggaatagtttcagaaggactggtaccagctcctccttctacctctggtagaatttggctgtgaatccatctggtcctgaacttttttttgttgctaaactattaattattgcctcaatttcagagcctgttattggtctattgagatattcaacttcttcctggtttagtcttgggagggtgtatgtgtcgaggaatttatccatttcttctagattttctagtttatttgcatagaagtgtttatagtattctctgacgttagtttgaatttctgtgagatcggtggtgatatcccctttatcattttttatcacgtgtatttgattcttctctcttttcttctttattagtcttgcttgttgtctatcaattttgttgatctttccataaaaccagctcctggatttattgattttttgaagggttttttgtgtctctatttccttcagttctgctctgatcttagttatttcttgccttctgctagcttttgaatgtgtttgctcttgcttttctagttcttttatttgtgatattagggtgtcaattttggatctttcctgctttctcttttgtgcatttagtgctataaatttccctctacacactgctttgaatgtttcccagagattctggtatgttatgtctttgttctcattggtttcaaagaacatctttatttcttccttcatttcgttatgtacccagtagtcattcaggagcaggttgttcagtttccatgtagttgagcggttttgagtgagcttcttaatcctgagttctagtttggttgcactgttgtctgagagacagtttgttatgatttctgttcttttacatttgctgaggagtgctttacttccaactatgtggtgaattttggaataggtgtggtgcagtgctgaaaagaatgtatattctgttgatttgggatggagagttctgtagatgtctgttaggtctgcttggtgcagagctgagttcagttcctggatatccttgttaacattctgtctcattgatctttctaatgttgatagtggggtgttaaagtctcccattattaatgtgtgggagtctaagtctctttttaggtctcaaaggacttgctttatgaatctgggtgctcctgtattgggtgcatgtatgtttagggtagttagctcttcttgttgaactgatccctttaccattatgtaatggccttctttgtctcttttgatctttgttggtttaaagtctgttttatccaagactaggattgcaactcctgactttttttgttttctatttgcttggtagatcttcctccatccctttattttgaggctatttgtgtctctgcatgtgagatgggtctcctgaaaacagcactgtgatgggtcttgactctatccaatttgtcagtctgtcttttaattggagcatttcacccatttacatttaagattgagattgttatgtgtgaatttgatcctatcattatgatcttagctgattattttgctcgttagttgatgcagtttcttcctagccttgatggtctttacaatttggcatgtttttgcagtggctggtaccggttgttcttttccatgtttactgcttccttcaggagctcttttagggcaggagtaatggtgataaaatctctcagcctttgcttgtctgtaaaggattttatttctccttcacttatgaagcttagtttggttgggtatgaaattctgggttgaaaattctcttctttaagaatgttgaatattggcccccacccttatccagcttgcagcgtttctgccgagagatcgcctgttagtctggtgggcttccctttgtgggtaacctgacctttctctctgtctccccttaacattttttccttcatttcaactttggtgaatctgacaattatgtgtcttggagttgctcttctcgaggagtatctttgtggtgttctctgtatttcctgaatttgaatgttggcctgccttgctagattggagaagttctcttggataatatcttgcagagtgttttccaatttggttccattctcccggtcactttcaggtacaccagtcagacgtagatttggtcttttcccatagtgccatatttcttggaggcttgtccatttcttttacctctttttctctaaactctcttctcgcttcattcattcatttgatcttcccatcactgatacactttcttccagttgatcgaatcagctactgaagcttgtgcattcgtcatgtagttctc

SEQ ID NO: 12676 - DNA, 27862 bp, Homo sapiens
tttctttctttttttttaatttattattattatactttaagttttagggtacatgtgcacaatgtgcaggttagttacatatgtatacatgtactgtgctggtgcgctgcacccactaactcgccatctagcattaagtatatctcccaatgctatccctcccctctccccccaccccacaacagtccccagagtgtgatgttccccttcctgtgttcatgtgttctcattgttcaattcccacctgtgagtgagaatatgtggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttgattccaagtctttgctatagtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgattgccattataactggtgtgagatggtatctcattgtggttttgatttgcatttctgtgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattccggatattagccctttgtcagatgagtaggttgcgaaaattttctcccagtttgtagattgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagacagttttcccagcaccatttattaaatagggaatcctttccccattgcttgcttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatagcattgaatctataaattaccttgggcagtatggccattttcacgatattgattctttctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggaatggtgagagagggcatacctgtcttgtgccaattttcaaagggaatgcttccagttttttcccattcagtatgatattggctgtgggtttgtcatagatagctcttattattttgaaatacgtcccatcaatacctaatttattgagagtttttagcatgaagcgttgttgaattttgtcaaaggacttttctgcatctattgagattatcatgtggtttttgtctttggttctgtttatatgctggattacatttattgatttgcgtatattgaaccagccttgcatcccagggatgaagcccacttgatcatggtggttaagctttttgatgtgctgctggatttggtttgccagtattttattgaggatttttgcatcaatgttcatcaatgatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagatcctgttcttggtctattcagagattcaacttcttcctggtttagtcttgggagagtgtatgtgtcgaggaatttatccatttcttctagattttctactttatttgcgtagaggtgtttgtagtattctctgatggtagtttgtatttctgtgggatcggtggtcatatcccctttatcattttttattgcgtctattggattcttctctctttttttctttattagtcttgctagcggtctatcaattttgttgatcctttcaaaaaaccagctcctggattcattaattttttggagggtttttgtgtctctatttccttcagttcttctctgattttagttatttcttgccttctgctagcttttgaatgtgtttgctcttgcttttctagttcttttaattgtgatgttagggtgtcaattctggatctttcctgctttctcttgtgggcatttagtgctataaatttccgtctacacactgctttgaatgcgtcatagagattctggtatgctgtgtctttgttctcattggtttcaaagaacatctttatttctgccttcatttcattatgtacccagtactcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaactgtgtggtcaattttggaataggtgtggtgtggtgctgaaaaaaatgtatattctgttgatttggggtggagagttctgtagatgtctagtaggaccgcttggtgcagagctgagttcaattcctgcgtatccttgttgactttctgtctcgttgatctgtctaatgttgatagtgtggtgttaaagtctcccattattattgtgtgggagtctaagtccctttttaggtcattcaggacttgctttatgaatctgggtgctcctgtattgggtgtatatatatttaggatagttagctcttcttgttgaattgatccctttaccattatgtaatggccttctttgtctcttttgatcttggttggtttcaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtttgtgtcttgtaattggagcatttagcccatttacatttaaagttaatatagttatttgtgaatttgatcctgtcatgatgatgttagctggttattttgctcgttagttcatgcagtttcttcctagtctcgaaggcctttacattttggcatgattttgcagcggctggtatcggttgttcctttccatgtttagtgcttccttcaggagctcttttagggcagacctggtggtgacaaaatctctcagcatttgcttgtctgtaaagtattttatttctccttcacttatgaagcttagtttggctggatatgaaattctgggtggaaaattcttttctttaagaatgttgaatattggcccccactctcttctggcttgtagagtttctgcccatagatccgctgttagtctgatgggcttccctttgtgggtaacccgacctttctctctggctgcccttaacattttttccttcatttcaactttggtgaatctgacaattatgtgtcttggagctgctcttctcgaggagtatctttgtggtgttctctgcatttcctgaatctgaatgttggcctgccttgctagattggggaagttctcctggataatatcctgcagagtgttttccaactggttccattctccccgtcactttcaggtacaccaatcagacatagatttggtcttttcacatagtcccatatttcttggaggctttgctcgtttctttttattcttttttctcaaaacttcccttctcgcttcatttcattcacttcatcttccatcactgatatcctttcttccagttgatcgcatcggctcctgaggcttctgcattcttcatgtagttctcgagccttggttttcagctccatcagctcctttaagcacttctctgtattggttattctagttatacattcttctaaatttttttcaaagttttgaacttctttgcctttggttcgaatgtcctcccgtagctcggagtaatttgatcatctgaagccttcttctctcagctcgtcaaagtcattcttcatccacctttgttccgttgctggtgaggaactgcattcctttggaggaggagaggcgctctgctttttagagtttccagtttttctgctctgtttttttcccatctttgtggttttatctacttttggtctttgatgatggtgatgtacagatgggtttttggtgtggatgtcctttctgtttgttagttttcctcctaacagacaggaccctcagctgcaggtctgttggagtacccggccatgtgaggggtcagtgtgcccctgctggggggtgcctcccagttaggctgctcgggggtcagggacccacctgaggacgcagtctgcccattctcagatctccatctgcatgctgggagaaccactgctctcttcaaagctgtcagacagggacatttaagtctgcagaggttactgctgtttttttgtttgtctgtgtccagaggtggagcctacagaggcaggcaggcctccttgagctgcggtgggctccacccagttccagcttcctggctactttgtttacctaagtaaacctgggcaatggcggcgcccctcctccagcctggctgccaccttgcagtttgatctcagactgctgtgctagcaatcagcgagactctgtgggcataggaccctccgagccaggtgtgggatataatctcctggtgcgccatttttgaagtccgtcagaaaagcgcagtattcgggttggagtgacccgattttccaggtgccgtctgtcacctctttctttgacaaggaaagggaattccctgaccccttgcacttcccaagtgaggcaatgcctcgccctgcctcagcttacacagggtgcgcgcacccactgacctacgcccactgtctggcactccctagtgagatgaatccggtacctcagatggaaatgcagaaatcacccatcttctgctgggagctgtagaccggagctgttcctatttggccatcttggctccacccttcttttgctttttcacataaatgttaggatctgcctttcagtttttacaaaagcctgcttggatattgaaattgcattgaatctgtagatcaatttagggacaatttacatcttgacaactttgagctttgtaatccatgaacatcaaagatttttaatttttcttatcaatattttgtagttttaacatacaaatcttgtgcagattttgttaaatttatatctaagtagttggtgtttttgatgtaattttaaattatactttaaaaaatttgtgattttttccttgcttttatacaaaaatataattgatatttgtatattgttcttatataccaagacctcatatcccaaactcagttattaaatatagttgtctttttcgtatatttttggatttttaaaatgtagacaatcatgtcatttgtgaatataagtagttttttttttatttttaactgtattctttaattttttttcttcttttgttgtaccggttaggaccttgcatacaattttgaacagaagtggtgaatagctttttaactttttaaaatgtttcatttactattatgtgatatttggaaatgtggcggaggcactttttttattttttgacttttttattattatactttaagttcttggatatacgtgcagaacgtacaggtttgttacataggtatacacgtgccatggtggtttgctgcacccattaacctgtcatctactatttgtcctcatgctctccctcttctagccccccacccccctgacaggccccagtgtgtgatgttcccctctctgtgtccgtgtgttctcattgttcaacacccacatatgagtgagaacatgtggtgtttggttttcttttcctgtgttagtttgctgagaatgatggttaggggaggcactttaaaacataaaattccaatattctcattttttaatcatcagaaaaatcaatgaacattttggcaaaaaaggaaaagaatagtctgtgtgaaattttacaccagcatttgattatggaaatagaaatgggagaaccttggagatcaatttatccaattatcttattttacatatgaggaaactaaagttctctattccttaacatacgatttcttaagagaaaataacatctctatagccaccggttcaagttttaattttgggtgtccagagctcagcctctgcctcccttaacacagcatatcagaaaacaccatagctttgtgctttgaggagtgttcctttctgtttgagccttgtcctctgcaggaactgtttagaggtagataatgctgttatccacccccggagatgatgacttaattgttctggagtatagcttgggcactgggtttttaaaacactttccatgtgattttaatgtgctaacagacccattcctagggcagtatggcactcagaaccttaggtggaagcttgttataatcttagagtcagatgtgactcaggtgttttggattttaatagacaccaggtgcaggatccccttctaagggctgcgtaagtatgcagcgtccgtcgctcttggcctactgcctatgaggacctgcagaggtcttacagggtaatttctgctgccggggaaacagcctttctgtgcatcgactttcagtgaccttccagtcgtgattccctcctggccttcacctgcagatgtccgcctgcctgttcttgccggctggctcggcagaaacactcatgccatctgtgctgggctgtctggaccaagaaggtttggacagagggcggacattcctgtggagtcaaaggccagcagtactgccctggctcagagcaaagaattttaaggtagctctacctccatgcagcagcttctcacattgtgtcttagaagaggtgcagaattatcaggtaagtcctctatccttagcaaatctgaccttcttctaacattttcttttttaaaaaaacaaaaagagtaaaaagtggcatatttgcataccacaggggacatacaagtcttatttaaggaacataattatgatattttaccctcatttcactaaccattttattcactgtaataagaactactccagaaccaaagacttaaaacatgaacaaattaaaaccatgtagggagcattcctgaagcattcctcctcattctgttttcaagatctataaacaccatatgttgagtggacagtattagagtgttctggcttaaactatggtctgtttttctttctttctttttctttttgtattcccttgagactgacctaattgattcaaaagacaaaagaccaaggacattaccagagaaacaggaatcaaatactaagaattcacatgcatatggaattacttattttatcaaaaaatgttcctgaacttcacacagcaaatggccaaagtgattcttttaccatctgattgttcagttaatataaagagtcctgtactgcattcttagcatgaataacacacagtgaattagacacatagaaagttgtcttaccttgaccaaatagcagttacacttgggtgaagaacaagttttgctgctgagaaacttaagaaaaattgacagacatccaatttcacatgatcattaattctttttctctggaaataaggccaagttttatggacgatgaacaccaatgagagtaaaagttctttaggaaatcgctttctagctaaacctagtttcttattactttccacccacctgtctctctacttattcaacccacttcaattcctcctttcaaatagacaggcagacgtttcaggcaactagacctgctttttcagtagccttttccactagggtggtgagtgggcaaggctaacatttgtacaagatgctcatgttgatataactgaatctgtgagttcaaggactcaatatgccacaattcaaaaaactgtatcagcaaccatatgtattttttaatgaaataaatattactgacagcacatgctttattaaattgataatgcaatgcagcattgtcttttctcaggattggtacatctggctgtacatcaaaccccatctacttacatacaatagcgttgttagttgtaacattcagtaagattcatcatccagtaaaatcacctttgtcaagtgctgagccacagacaactgcaccctggcattggaagccatactttttgatcccatgaataaagatgaaatctaagacctctaaaatgcagtcaagataaagtagaatcctttgtaacaccactcagggaaacgcatgtgcttgcaaatgtctggtttcccagctttcatggcagtgcacactgcattctggggatattgctagacaggtgggtcaggatgcaagcctaatgtgcacccctcccctttccaccaccaccaaagcaagtatacctcctttcttctgagagcagagaaaatgggtttagacaagagggatactgacaggaagagaaaaaaagggagaatctttctcattctatttgttatgggagaaagctaagcaaacaattgaaagcaaaccctatttccacagccctggatgctttccaagtaacattttaaggaaatctaataacaactaatatttttgagcatttgtcatgcattaggcacttttctcaatcacatgaattaactaatgttatccacacaacaatgctactattatttaccatctccatatttctaaagagaaaactgaggctaaaagaagttaagaaaatttcacagatagtgtgagggtcaagtttaaaacttagccattcttgggccagagtctgcattattaaccattgctttctacagacgtctctgacaagaacttgatattcattatcttattaaacctcaataattctgtgaggtgactactgtttttctactttacagaagaggctatggagacatacagaggttaaataatttgcacaagtgaacaccatttgtatactcctggagctagggttcaaacccacacgagttaacaaatgacagctagcctaaccttcttgcaatattcacaagacatctaatcaaagggcccagcaaacactacatctgtgtggtcttttgctacatcccttctgtgcctttggcatcgccatctccacctctgtcctaggaggagctcatgtgggcaccagatcacatgttgatggtatgactgtcatttttaccattctagactacaggttgcagctggctgcatttcaaatcatgtcatcattatactttaggactgataataatactgcgggcaatatttctacttaagcttgacattgtgacaaaagagatctatgcaaaccaatgcattttcaaatatcaaagtatgcttcaaaataccatgaaatacttagacttccaacatgagtaggtgcatttagaaggcaagctgtcttgtattcaatatacattttatctgagggagcaaaagttagaatatattttccttggagtctataaaaatcacatagcttgcaacagaacatcataaatttactcaggccttttcagatattgaactaaatatatcaaatataaaatacatatgcatatctttagcctgcacatgtttatggtaactggtctccgaggaatttctcttctcattatataatggtgtaaatgctttgagaggcagtgagagaagatacattccttcaatatctccaaatgataaaagatagacatcttttgtttgatgagaactatagtcaaaataaccatttaaagagtacataaaaagaaagcacaaagtacaattgaataaaaccagacctgagtttctgtggcagagagagtccagacatagcacagatggatccagaaaaaggctagcaccattagattttgaaattagggacgcaatctttgataagaggtgagggaaaaatgcttcttggctgttttccactttggaagtggaatgagaatgagaggagtttccttttgataatagcctcttggatggatttaatcactttaattttggattccctctattttctcttgccagctactaatacttataacaattctcagattctgaatgtctatgtaaatgcaactacaagccctgtgtatggggtgtgaagattttactacattataagatattttaactgttattaactcttaaaaacccaagttgaagctttaatgtttatgtagattttcaaacaggaatttttgttcagaaaattttcaggtttgtgaaagggtcagtgttagagaaaggaaatccctactttcatggtttctagtgatattctggcagaggatagatagattccagatgtttcttttggtcaaaggatgagaacaaaaactattgctctgaaaaatcagagccacctggcccgagacacatcatggaatagcggagagaatattaagtggagaatgagaaattactgattttcaccaatagagaaatgtagtagagactgctacagacttaagttgcttaactattctgaatctcagctgttaagattaaaaactaggcagtctctacaggcctcttccagctggaaaagtctaaggtataaatttattgttaatagtagctgttattattcttcttaccatttatttatatcccactttggaacataaagtgtttgaggttggccaggtgcagtggcctatgtctgtaatcccagcactttgggaggccaaggtgggtggatcacctgaggtcaggatttagagaccagcctggccaacatggcaaaaccccgtctctgctaaaagtacaaaaattaaccggatatggtggcacacgcctgtagtcccagcaactcgggaggtgaggcaggagaattgcttgaacccgggaggtggaggttgcggtgagccgagatcgtgccactgcactgcagcctgggcaacagagcaaactcttgttttattattaaaactcagttttaaataataataataataataaagtgttcgagttcatgccttagagaaacattattcacaactggatacaataagtagataaatgggtcaaaggaagactgaagtagttaactaaaataaagattagtgccacttccctgatatcagtattaagatggtgtgaagtactgtctacaggtagcacaaggttttactcagaggaagatctaggtcctcttgaacttttatatacatgggttctgagatcccaaagttcaattctatagggcacaaccacaccaatttattttggaggattttcaaacgaagtattgatgattgcctgtggtagtataaaatagtttccataaggatatatgcaggtcagctaatttaaaccaatttagctcttttacaaaaatcaaacgtagattagtgagaaaaatataaccctagatagtaaaacaatttgatttcatgtggagaattgacagacacttgccgattaaacattggaggacacttgtcaaaagtgattattttggctttaaaattttgattttcaactcactctttttaatgaaaatcacatggaaacttgttactttcttttggctttatttattcttagctacttgggagggtcattgcctttcagccagcatgtaaccccaggagcaatggaggagacactgtctagttcatcagttcaaacctgataagcagtgagttcacaggtaatgcaaccaaatcacttgattatccacctgaaaacaatgaaatagagaagcacatttagctgtctgtatttggtagcagaagagccattgttcccgcatttatcattaagatccaaggcaaagagaaagtggctaaaaacccaccaccattttacgtacttaaaatttgatatctagtatatacatgaataacaatgaatctggagtgaattcatacataattagtttctgtccataaattcgaaggttgaatagctatcaatgagagttgcaaatcttctgctgcatctccgcgtttctcaaaggatgatacattgtgtaacaatcatcagccatggaagagcccaccttcttcctgtgtaggatgttggcctatttacaatttgttgccccaaaaaagaaagtgacatgaaatttggaaaatatctttaacaagccagtagattcataacttgctgagatcccaggattttcttcaaagaaaagtgattgtctctactttgggtacctccagagtaggggtgggggccacatccatagagttaacaatggaaatgaagagtcaatgatcaagacccaccagaagtaatcaacctaatgaaattctagtatcagaaaaacaaagattcttcaaaactctgtcatttctttctggagaaaaacagtctttctagatgccaatcaggattgggacttttattattgtattcactgttcaccaaattataccaaggaaaaccatataatagaatatgacctcattccatttctacttgtccaaatcatatctcactatcaaaattcctacattcaaatttcatgagggtgtaaagagcttatagtgaaatttaaatgaaataaacacttaggtgactatttccaaattctgtctcctatgttactccatcaacccagttaggagtactcttagcttcttggtgatcttcctcaaaaaaggaataagagggcaagtcccacaatggaaaaatctcatagcatatgtgccagtctgccaataatatattgatagggaaattttatctactaagataacaaagatacagtttcaaaaacttcccagttatgaaaagtcactaatggagctttaaaaattctcatttcatttcaatttttaaaacactttaaatcttaccaatccagtcttatgtctggtacatgagggactgtaccatataaaaagtatggtgtaatctctcactaggattagtgaaggggcctcctctactgtgttatatgtggtctcaataggcagctacatgtgttggtaagcaaagagggtaatcataataattgttggttctgcaggaagtgactcaatgaaaattacccccaaatttgttttaggtactacaacttaggacctttatataggatgtttcatatgtattatcacatttaattctcatggcatatacttgcataggatcattttacagacgaggaaactgagggaagtatgttttgtaaatttagtacacattctccatgtctggtgtagcctctttgaaataaaaaagcatttcttaataattatttcattaaaatttaatgttaaagcttttactgtcttagtagtttatagtttgtaaaagttaaatcacctgtgttttctcttttgaataggaaatggtattggttttttgttggtgaaatggttacctacttcaaagatatgactgtgataattttacaaaacatttctaagtacaatgtagctgagagctgttttcatatttcctatggtacagcatgttctctgatttcataatttatcttcattttcataagcaatattttccttgaacttgttttcaaaggaaattgcaattaatatatgagttttcaatgagttgatattcatccaaatctgatggctcaaagaaaattgcattgtattaaaaatgttggggtatctcaactgtttgccttttagcaactgtttggcaaaactctcacattccaaatctccacagagcagtctcaggagacgaacatgtcttgcacatgatttgtctttagggatataagaatccaacttttaacagactaaaacccaactgaggaatgatgtctttaaagtatgtgtcagacaacccttcaaaaaaagaaaaatgaaatggataaaaatctctaatacatttgggaaaatatatactctactatactttccatatggtaagtgaaggaataaattacattattgattaacatattttctagatgaattttatcttctcagtccttctagagaaggttattactaaatagttctatatcaaataactggaagtaatgaaaattgcacatgtcaatgatcacagatgcctttaggatatccttgtggaaaacaaagataaccacatggatttcatgtacttttctttaaaaagcacttagccttttgtcaactttgagagattgaatcaaaagaggtatatttggtaatgttataaactttctctgctagaaaagctgccatcaattctacaactctgaaaatcttaaaccacaaagtacaaatctttaaacaaagcctctttcctccaagacttctcagttcttcactcccaagtacacgtttttctctcagagattgtcagttccccaagccttctcacttctcccagtttattgccagcttaactctccagcacaaggtcttctatcttttcccctcaactgccctgtaaaccctcaataatggctcagtttacttactcatctgtctccattatttatgtttttatttgctatcattatttttaaagagatagggtctcactatatggcccaggctggtcttgaacttctggacttaagtgatcctcctgccttggcctgccaaattgctcagattacaggtgtgagccaccgtacctggccctcatttcttttgaaattttagagctgccagctctactggggaagtcattaggttcattcttctttggaacccaaaagctggcaatatacaaaattagaggttttcatctttctccttccactcatatgttctcctgtgccccgtcccatgtcaatgaagggtacactgcccaaccagtatatgagtaccttgtacagcacatctaaccattctcagacttgttgactttctctctctaatatgtccagaatctacttcccgtctcaacattcttactgccattgctttaggacattccatcattattatttcatgtttggattgctgcacacatgtcctaccttgataccctccctctatttttaccctttctagtctattcttcttattgagatagagtcatttaaaaaaaattctaatgtattatgttgcttgtctctttaatccctccatcgactttctgccacaaacagtctaagaacatgtgtgtcccttaatatgactatcaaggtcttttgtgacctgttacccacttgccttttttgacctatattctacggaattattgcagttttctaatggtaaattttttttttgttttttcatagttttccccctgtgtttgaagtgccattatcaatgttcttcatccataaaatctatggtagttcctctaagacagctagatgcttccccatcctgaatcctgacttatcttcttaccttactctggggttcatatttctcctgggtgcttccttagtaccacagcataatatcaccatgtatcaatgttatttgtccaccttatctgccagattacatgctttttaaaagaaagggcaatgttcagtccttatatccccagaatctacccaagagtatgccacttctcagaaatgtttgctgaacaaataaatgaagaatttattaaaagagtgaacatatgaatggatgaatgctctcaaaggactcatatgtttttctccaggggagaggcaagggctaaaaataagaatagaagatttagttgagtaataggctaactgctaggaatataaaggcatattactgtaacattcaagaatacagtaagccaggtgcggtggctcacacttgtaaccccagcactttgggagcccgggtggatcacgaggttaggagttcgagaccagcttggccaacacagtgaaaccccatccctactaaaaatacaaaaatcagctgggtgtgctggctggcgtctgtcattccagctactcggaggctgagacacgagaattgcttgaatctgggaggcagagattgcagtgagctgagatcatgccactgcactccagccttggtgacagagctagactctgtctcaaaataggtaaataaatgcataataaaataaatataaagaaaaagaatacagtagcccctccacacccttattcatgggggatatgtcccaggaccccccagcggaggcctgaaactgaagatagtactgaagcctgtataaattatgcatgattttttccttcagaatttcacaggcagaagattcatccttaccatagattttagcaacttaagcaggcaattttttttcttctcttgttgagaacttttcccttcttgcttaaagaaagcaatttatggcttcttttttggtatatccaaacagccagcatcactaatgttgtgctttggggacattgttaagtcaaataagcattacttgaacacaagcactgtgacaccaggacagttgagctaataactgaaagggttactaaatgactaagggcagggtggtagcatctataatgcaggttcactggacaaagggtagattaatatcctgggcgagatggagcaggacagtctcagatttcatcacactactcagaaatgcatgaaataaaaaacttataaattgtttatttcttgaatttttccatttaatgttttcagactgcagttagtgtcaggtagctgaaactgcaaaaagtaaaaccatggttaaaagagaactactgtatagtttgggagcaagattcccagggttcaaatcttagctctctctggccttattttccttatctgttaagtgagaccaagactagtacctacctctgggttcttctgaaaattcaatgaggtcgtatgtgtaatattcttagactttgcctggcacattctaagttctcaatcaaagttggattttattttgtaccctttctgacagcccagacctctactggagataacaagaggcttgcaggatttgtttaaagtcaaaaaattttttttttcccagatgactgtttggagattacctcaaataaatgttctgtaagaggcaaaaagaacaagttgcagttatgttggcttgttcagttggggagccagtgttagttaagagtgtgagtcagctacacacaactaatggaaagtgctttaggccaaaaatgcgcagaccctgactgcttacaaccacatttatcgcctctcttctacaagccctttatttgcttgctcaggatgttattaatagaataaaacaaggaacgatagccagggacctcgtttttggtcccagccatgccaccaatgagttgtgtgacttgaatcaacttggttaaatttggtattctctatttctataaaatgagaattagataatttccctacttacttcaagaaaaataactgatatgaaactattgagataggagggctttatactcttaggcacttgactttaagacagaaattctgtccagctttgtataatacctttctttcttttttttcagagattaaaaaaaaatccataagtgtacctctttagtgtcatctctctgtccgccagtgcttgctctcttggtggttataaaaaatgtggagaaactccacatggctgatttgggcaggggctggagttagttgcatccagtttctaggtgtgcattgagaactgttaagtgccaaccttcttgataggtgtgcagaatatagtaataagtaagataggatgtaatcctgggaagctcacatttattgaggaagccctggtaactgacctatgtgttttaaaggccataggtctgtgaagaggtttattttatctccctctagcaaaagaaaaactgtttgtaaatttgttataaaacagtacagtacaaatttgttttataacaaatttgttataaaacaaaattcagacttgttagcatattttaattttttctatattaaaaaatggtgattcttagttatgagatgaggtcagtacaggagacccacagtctctaaaaaaatgtgcaccctcagatattttggacacagatataataaaccaaccactctgtattgaagataatcagaatcaatacagatctgatgagattagctacctgaaccagtcagttggggccacagaagcttgtaagcctgctgtccgggagtgaggggtatattatgtgtggcttatctagaggccaggtgttcccaaattcaatcaagatggtcagtgtcctcctggaaaatataactgtattctaactgatagaaataaaaccatcatctttgcaattgtagtggaaagaatgtgaggtgaattgcaaaataatggaaaggtgatgatttatgatttacactaagtagagaaaatgcaagattctgtgtgccttttgaggactgcccaagagacgaatgtcctgatgttcacaaacaccatgtctgatagtgatatggttgccaatgtagacgttcttcaagagaagactgtgcatgcagctagccaacataaatattcttgactgctccatgcatatttttcactggaaattaataagtgtactgaacaatctttgtgttgtactcctttatagtcttttagaacttttaaaaaatatcctgactttctggcagactgacattgggcaaggttagtgaatctcctaaatgcttagtttcttcatctggaaagcagagataaaatacctgcctcagtgttgttatggaaattaaattagcaatacatcaaaagcacttttcacagtcactagtgcatgggcagtactcaatgaatggtaactgttattatgaatattattgtagctttgggtaattcccagaaatctcttcaggcatggctgaccattttttttttgggggggggatacagtatcaggcaaataaataaatgtgtatgagtgtgtgtcatatcatgcaaataaataagtgtatcagggtgacatcacaccaataaacaagactttgtttagaaatggtgctattgataatgatttctgattgatttgtagaaacaatattgcttggtgaaataaatgatttaactatgggtctgtgctgttctgtaggccccaggaccccccagtgtttagacatgatggggactcaataaaacataaattctccttgatttattgctcagtcagcctcctggatcactagtcaaagaaaatgaaaatactgatttataccctcatgctcagaatttccacgttgaatctttcactgaaaatcagacttttacgaatgttgacaaagaaaaatttaaaaactgtggcaaggtacagtttatccttggtaggacatctgtcgattgtcactaagcctgggcctttacatcctagccaagtgggtaataaattagctatagaaaatagtcattaagagactctataaaacactaggtaagaatacaaactctagagtaagcttgcagagatttggctttttcattttctagctctgtgatcttgagcaagatacttgagcttactgtgaaatgaggatggtaacagttagtacctaatcaagaagagaaaaatagtgcctagaatagggatgcagaatgtcagatgaggaggtagtggaggaattttaagtaggatggtcagggaggtttgcggagaaggagactgaagatctgaaagaggatgaagatgaagaatgcagaattgtcttggaaaagaggacatgaggcaaaaggagcagagcaggtacaagtgtccccaggagagaatatgcccagtatgatggagatagattgtgagcactttgagatgaattcatagagtacatggaggagacacgtgtgaggtcattatagtaactttgagtaaggaaggcgttggcaggtgtggagggttgaattgtgtctcctgaaaagacatgttcaagtcctaacgcctagtacctatgaatgtggccttatttggaaatggagcctttgaagatgtcatcaagcttagatgaagtcatactgaactaggttgggccctaatcctgtgactgacgtttttataagaagagggaaatttggacacagacacacagggaggggaacaccatgtgaagatgggagcagagactggagtgatgcagctgcaagccaaggaattacaaggaattccaggattgccgctggaatctaggaagaggcaaggaaggatcctctcctggagccttgagagagagcatggccctgctgacaccttgatttcagacttcgaggctctagaactgcgagacaatcaatttcagttgttttaagccactcaatttgtggtgatttataatggcagccctaggaaaactaatacagaggatttagaacacacaagcttgctcctacgactgagttgacaatagattacagaggagaaagactggaagcagcaaagtcagttaggagctattacaataaatcaagcaaaagattgcatttgctttagagtagagtagtggtggttgcagtggtgaaaagtgattggattctggatattgtcaaaaggtagactaaatagctttactaatgagtcatatatgggatatgaaaataaaggaggtatccaggaagattctaagtatagaagaatggagttgatttaactgagatgaagaaaactttgagtggcacaggtttggggcaaagatcaaaagtccagtttagggcaagttaagtttgagtcatcacttagagatccaaggggaaatgctagtaggcaactgaatacctgagtctggagttcgggacagtgtttagggtggaggtgtgttttagtttgttctgttataacaacataccttagactgggtggcttataaacaatagaaatttatttctcacagttatactctgggaagttcaagatcaaggcaccaatagattctttttttttttttaagttgatatggaactttatttatttctttattttttgaatttttttttttaattatactttaagttttagggtacatgtgcacattgtgcaggttagttacatatgtatacatgtgccatgctggtgcactgcacccactaactcgtcatctagcattaggtatatctcccattgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtcactacaaaggacatgaactcatcattttttatggctgcatagcattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctaaggaatcatcacactgacttccacaatggttgaagtagtttacagtcccaccaacagtgtaaaagtgttcctatttctccacatcctctccagcacctgttgtttcctgactttttaatgattgccattctaactagtgtgagatggtatctcactgtggttttgatttgcatttctgtgatggccagtgatgatgagcattttttcatgtgttttttggctgcataaatgtcttcttttgagaagtgtctgttcatgtcctttgcccactttttgatggtgttgtttgtttttttcttgtcaatttgtttgagttcattgtagattccggatattagccctttgtcagatgagtaggttgcaaaaattttctcccagtttgtaggttgcctgttcactctgatggtagtttcttttgctgtgcagaagctctttagtttaattagatcccatttgtcaattttggcttttgttgccattgcttttggtgtcttagacatgaagtccttgcccgtgcctatgtcctgaatggtaatgtctaggttttcttctagggtttttatggttttaggtctaatgtttaagtctttaatccatcttgaattcatttttgtataaagtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgctctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttcaagtagttttttccaattctgtgaagaaaggcatttgtagcttgatggggatggcattgaatctgtaaattaccttggacagtatggccattttcacgaaattgattctttctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgactcttcttttcctaattgaataccctttatttccttctcctgcctaattgccctggccagaacttccaacactatgttgaataggaatggtgagagagggcatccctgtcttgtgtcagttttccaagggaatacttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggttctgtttatatgctggattacatttattgatttgcatatagtgaaccagccttgcatcccagggatgaagcccacttgatcatggtggataagctttttgatgtgctgctcaattcgttttgccagtattttattgaggatttttgcatcaatgttcatcaaggatattggtctaaaattctcttttttggttgtgtctctgcctggctttggtatcagaatgatgttggcctcataaaatgagttagggaggattccctctttttctattgattggaatactttcagaaggaatgttaccagctcctgcttgtgcctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtggaatcggtggtcatatcccctttatcttttattgcgtctatttaattcttctctctttttttctttattagtcttgctagcggtctatcaattttgttgatcctttcaaaaaaccagctcctggattcactaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcgtttagtgctataaatttccctctacacgctgctttgaatgtgtcccagagattctggtatgttgtgtctttgttctcgttggtttcaaagaacttctttatttctgccttcatttcgttatgtacccagtagtcattcaggagcaggttgttcagtttccatgtagttgagcagttttgagggagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttgaggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgtgtgcatatatatttaggatagttagctcttcttgttgaattgatccctttaccattatgtaatggccttctttgtctcttttgatcttggttggtttaaagtctgttttctcagagactaggattgcaacccctgcctttttttgttttccatttgcttggtagatcttcctccatccttttattttgagcctatgtgtgtctctgcacgtgagatgggtttcctgaatacagcacactgatgagtcttgactctttatccaatttgccagtctgtgtcttttaattggagcatttagtccatttgcatttaaagttaatgttgttatgtgtgaatttgatcctgtcatgatgatgttagctggttattttgctcattagttgatgcagtttcttcctagtcttgatggtctttacattttggcatgattttgcagtggctggtaccggttgttcctttccatgtttagcgcttccttcaggagctcttttagggcagacctggtggtgacaaaatctctcagcatttgcttgtctgtaaagtattttatttctccttcacttatgaagcttagtttggctggatatgaaattctgggtggaaaattcttttctttaagaatgttgaatattggcccccactctcttctggcttgtagggtttctgccaagagatccactgttagtctgatgggcttccctttgtgggtaacccgacctttctctctggctgcccttaacattttttccttcatttcaagtttggtgaatctgacaattatgtgtcttggagttgctgttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgcacatttggtcttttcacatagtcccatatttcttggaggctttgctcatttctttttattcttttttctctaaacttcccttctcccttcatttcattcatttcatcttctatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcagagtaatttgatcgtctgaagccttcttctctcagctcatcaaagtcattctccatccagctttgttccattgctggtgaggaactgcattcctttggaggaggagaggcgctctgctttttagagtttccagtttttctgttctgttttttccacatctttgtggttttatctacttttggtctttgatgatggtgacgtacagatgggtttttggtgtggatgtcctttctgtttgttagttttccttctaacagacaggaccctcagctgcaggtccgttggagtaccctgccatgtgaggtgtcagtgtgcccctgctggggggtgcctcccagttaggctgctcggggtcaggggtcagggacccacttgaggaggcagtctgcccattctcagatctccagctgcgtgctgggggtaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccaattcgagattcctggctgctttgtttacctaatcaagcctgggcaatggtgggcgcccctcccccagcctcgctgccgccttgcagtttgatctcagactgctgtgctagcagtcagcgagactccctgggcgtaggaacctctgaaccaggtgggggatataatctcgcggtgcgccgtttttgaagcctgtcggaaaagcgcagtattcgggttggagtgaaccgattttccaggtgcggtctgtcacctctttctttgactaggaaagggaactccctgaccccttgagcttcccaagtgaggcaatgcctcgccctgcttcggctcgagcacggtgcgcacaaccactgacctgcgcccactgtctggcactccctggtgagatgaacccagtacctcagatggaaatgcagaaatcaccgtcttctgcgtcgctcatgctgggagctgtagaccagagctgttcctattcggccatcttggctcc

SEQ ID NO: 12677 - DNA, 8360 bp, Homo sapiens
ttttttttttctttttttttttttttttttgagatggagtgtcactctgtcacccagggtagagtgcagtggtgcaatctcggctcactgcaacttccgtctcccgggttcaagcgattctcctgcctcagcctcctgagtacctgggattacaggtgtgtgccaccatgcccggctaatttttgtatttttagtagagacgaagtttcaccatgttggtcaggctggtctcgaactcctgacttcgtgatccacccgcctcggcctcccaaagagctcatctattttctagaagctgatttggaaaaaaaaaaaaaaagagaagtctctaaattaccctttacccaaacttccagtcatcaaagttaccactgtttaagtattgtaaaaaaatatatatagattttatatgtgtagcaaacagcattctatttctttctgtgccatgtgctacaaagtggagcgtgttgagcatcatgaggcattgcactaccatttccgggaaaatatactttaatgacattgaagtgcaaacagtctcatggaagcaaactgtgcagctttggctaagaatgggctgaagccctgtgcaaacaacaatgagatactgaggacaatcttaaaagtactgaagaatattgcttttaaaatcccaaacctatgtatagttctttgttatatactcattaatgaaagctaaggggaccagggaagggaaatagggacttaagttactgctgcttgccttttctttactaattagattcaagagcattaaaaactatgattaaaacgtgtacgcttgcttcattgcatcttttgtctcaatgtgtatttaggaaaacctaagttatttgtttttattatttttaacaaattgcagtttcatccaagtaatattttcttgttgtatagtgccacaggaattctgaacattgatcagtctttaaaatgaaaacaagtatcttttttcattgcttcattttatttcttgttattttcagcatattggatggatatttagattatcccattttttcactattataaacaatgttttgaggaattttttttttttttttgagacggagtctcgctttgttgcccaggctggagtgcagtggctcaatctcggctcactgcaagctctgcctcccaggttcatgccattctcctgcctcagcctcccaagtggccgggactacaggcatgcaccaccatgcccagctaatttttgtattttttagtagagacggggtgtcaccatgttggccaggctggtcttgaactcctgatgacctcaagtgatctgcctgcctcggcctcccaaagtgttggggtgtgagcattgcgccagccagaactttcttaattacaaaattatcttatgtgaaaagaaatgttcatgcaagaaaatatagagaaaccacaatatactgcagtaacatatgtagaacccacttgctcagaatagctattaatgctctggagatgtgcatgtctgtaacatgtctgtgtgcatctgtctatctacttacatctatctatctatctatctcctttagatgacataaatttataaagattggatgtactatatatactttttgagttcaaaaaattttatttagaagtaatttaaacgttataaaagattgtaaaaacagttcaaagcacacacacacacacaccctccctttatccagatttttacttattttgtcccacttatttgttctctgtctcaccaacacatatacctcttttattgtttctggacttccaaccagttttgttaaagccaggttacagaggaagtcactcatgttttcttctaggacttgtatagttttattgctttcatttagatctctgcttcatttgtagtttattcatatgtatgttgtatggaattcatcttatttttctagttgtcctaaaacaattaatgtatgtcaatcttttttttttttgttataaaacttatggttttattttgcagcaaccaaatattccttatataagcaacagataaacagagtactttaaaatatttgtttacaataaaattgggcttcccttcatatgttaaatacaacttatgtgccagaaaagtgtgaaaggaaaatagaatcttgggaccccaaactcactatgccaaaggagaagttaagcttgggaactgagtcatgcaaaaactgccttccttctgtccccagacagatagctgtaatttcacatatttactttctcttatgtaaaatatagatttattgagcatgagaggaatgcataattgacttattgttctactccctttctttcttcctttttttttttagttatacttttaagttttagggtacatgtgcacattgtgcaggttagttacatatgtatacatgtgccatgctgtcgctgcacccactaactcgtcatctagcattaggtatatctcctgatgctatccctcccccctccccccaccccacaacagtctccagagtgtgatattccccttcctgtgtccatgtgatctcattgttcaattcccgcctatgagtgagaatatgcggtgtttggttttttgttcttgcgatagtttactgagaatgatgatttccaatttcatccatgtccccacagaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgtttactctgatggtagtttcttttgctgtgcagaagctcttgagtttaattagatcccatttgtcaattttgtcttttgttgccattgcttttggtgttttagacatgaagtcgttgcccatgcctatgtcctgaatggtaatgccaaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttaaaatagttttttccaattctgtgaaaaaagtcattggtagcttgatggggatggcattgaatctgtaaattaccttaggcagtatggccattttcatgatattgattcttcctacccatgagcatggagtgttcttccatttgtttgtatcctcttttatttccttgagcagtggtttgtagttctccctgaagaggtccttcacatcccttgtaagttggattcctaggtattttattctctttgaagcaattgtgaatgggacttcactcatgatttggctctctgtttgtctgttggtggtgtataagaatgcttgtgatttttgtacattgattttgtatcctgagactttgctgaagttgcttatcagcttaaggagattttgggctgagacaatggagttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcaatatgatattggctgtgggtttgtcatagatagctcttattattttgaaatacgtcccatcaatacctaatttattgagagtttttagcatgaagggttgttgaattttgtcaaaggctttttctgcatctattgagataatcatgtggttttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcatttttaattgcgtctatttgattcatctctctttttttctttattagtcttgctagcggtctatcaattttgttgatcctttcaaaaaaccagctccaggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctccacacactgctttgaatgtgtcccagagattctggtatgttgtgtctttgttctcgttggtttcaaagaacatctttatttctgccttcatttcgttatgtacccagtagtcattcaggagcaggttgtccagtttccatgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttaactttctgtctcgttgatctatctaatgttgacagtggggtgttaaagtctccgattattaatgtgtgggagtctaagtctctttgtaggtcactcaggacttgctttatgaatcttggtgctcctatattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtgtctgcacgtgagatgggtttcctgaatacagcacactgatgggtcttgactctttatccaatttgccaatctgtgtcttttaactggagcatttagtccattgacatttacagttaatattgttatgtgtgaatttgatcctgtcattatgatgttagctggttattttgctcattagttgatgcagtttcttcctagtctcgatggtctttacattttggcatgattttgcagcggctggtaccagttgttcctttccatgtttagtgcttccttcaggagctcttgtaaggcaggcctggtggtgacgaaatctctcagcatttgcttgtctgtaaagtattttatttctccttcacttatgaagcttagtttgtctggatatgaaattctgggttgaaaagtcttttctttaagaatgttgaatattggcccccactctcttctagcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtagctttgtggcgttctctgtatttcctgaatctgaacgttggcctgccttgctagattggggaagttctcctggataatatcctgcagagtgttttccaacttggttccattctccccatcactttcaggtacaccaatcagacatagatttggtcttttcacatagtcccatatttcttggaggctttgctcatttcttttattttttttctctaaacttcccttctcacttcatttcattcatttcatcttccattgctgataccctttcttccagttgatcgcatcggctcctgaggcttctgcattcttcatgtagttctcgagccttggttttcagctccatcagctcctttaagcacttctctgtattggttattctagttatacattcttctaaatttttttcagagttttcaacttctttgcctttggtttgaatgtcctcccgtagctcagagtaatttgatcgtctgaagccttcttctctcagcttgtcaaagtcattctccatccagctttgttccgttgctggtgaggaactacgttcctttggaggaggagaggcgctctgctttttagagtttccattttttctgttctgtttttttccccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggggggtgcctcccagttaggctgctcgggggtcaggggtcagggacccacttgaggcagtctgccctttctcagatctccagctgcctgctgggagaaccactgctctcttcaaagctgtcagatagggatatttaagtctgcagaggttactgctgtctttttgtttgtctgtgccctgcccccagaggtggagcctacagaggcaggcaggcctccttgagctgtggtgggctccacccagttggagcttccaggctgctttgtttacctaatcaagcctgggcaatggcgggcgcccctcccccagcctcgctgccgccttgcagtttgatctcagactgctgtgctagcaatcagcaagactccgtgggcgtaggaccctccgagccaggtgtgggatataatctcgtggtgcgcctttttttaagcccatcggaaaagcacagtattcgggtgggagtgacccgattttccaggtgccgtctgtcacccctttctttgactcagaaagggaactccctgaccgcttgcgcttcccaagtgaggcaatgcctcaccctgcttcggctcgtgcacagtgcgtgcacccactgacctgtgcccactgtctggcactccctagtgagatgaacccggcacctcagatggaaatgcagaaatcacccgtcttctgcgttgctcacgctgggagctgtagactggagctgttcctgttcggccatcttggctcctccctttcc

SEQ ID NO: 12678 - DNA, 6054 bp, Homo sapiens
ttttttttttttttttttaatttttttttttttattatactctaagttttagggtacatgtgcacattgtgcaggttagttacatatgtatacatgtggcatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccattgtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtattcctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagagctctgttctgttccattgatctatatctctgttttggtaccagtaccatgctgttttggttactgtagccatgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagaatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgagtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagggcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggagttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggttaggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacctgtcttctgcgtcgctcacgctgggagctgtagaccggagctgttcctattcggccatcttggctcctcc

SEQ ID NO: 12679 - DNA, 25036 bp, Homo sapiens
aactgtcaggttgccgtctaggtagcggttgtgcttgctgaggctgcacttgctgacactgcagctgcgacgcggctaagaggcgcagagcgaggagtcgggatttggtcgcgagcggcgacggtgggtagcagcgctccgggcagatcctgcgtccctgcatccctggcgaaagtagtggagggagatttaaagttccttggcgcgtgtttcctccccctgggctcttccccagaccgcgagtgattcagctgttgtgccggaaggtcccaaagtttcccctccgaggcgtgcaggaagaggaagtgagcaggagtgagggatgctgagcgattactgtcatcagaggttccggtcacttaaaacgttgagaaaaaataaccatgtataaagctctgttgtgcttaagtaagatttttcttaaaacaggctgggtcggaaggtgatggaagaaaacttatggccttttgcttactgcaatggcttttctcctctgcttctagtccctgctttggggaggggctggcgcgcccctttccttgagtgcagctaggcctggtgaaaggcacaggcgacatcaccctgctgctagtttgcatgttaattcgctcttcctttgcctcttgggggttccatttgaattcccagacccctgttttgctgtcagccagataattaccaagatgttattttatgtttctggcaacagagaagcacacaaaagttttgatcttgttttctgataccttggattagagactactgaaaatgtagtgaactaatgtgcgtccgccacccattaaagcagttttcatttttctcctttgtttctgaacctagaaacagtaaggaaaatgctactgttctagagtttcaaataactcataccttgttgacataaagcagggcagatggaagatagcatattttccaagagtgcggtgggtttttttgtgtctgcagtgtgtccatattaagaaacaatttttgagatctgaccatacttactagctcatttttaaataatcagcacccccccccccccacccctgttacctgcctggtctcaaatcctgaaggaagaagtgaataaaaatataaatggaccaagttatcacagtggtagatttgaagtcagtgaagcagccattccttgctgcagatacatgcacttattttatcctccctaattggcttaactaaagacagtcatgctgagatttagtttacttaacatgtgtatgcacagtgatactcactggaaaaagttgaactttcctttccacaatttagttccagcctgtgtttccattctatttttgcacttttccctgtatcttccttttctatttcaatttcctcatctctcatttatttttcagcccactgtgactaagacctgtaattgttttactttccagtgaaattgttcaagcaaacgtctcagcaacctcctaatctccaaattctatccaatcctcatggttctttggcatctaattctattttcttctcaaagttgtgatattgcttccatagttctaatgttctgacttcctttgctgactcctcttctttgctgactgttcttctcttgccctttagatgttagtggttctggctttaaccctcttctcattcacagtcgtagtccttaactctattagggctatggtcccctctgaacgcatatttaaagcgaaagatcttctttctagaaaaatacacattcacatttatgataaaaatattgcatacgagtcgggtatagggacctgatatggttaggtcttgtgtccccactcaaatcccatcttcaattgtaatctccacatgtaggggaagggaagtgattggattataagggcgatttcccccgtgctgttctcatgatagtgaattctcacgagatctgatggttttataaatggtagtttttcctgcactctctcacatactgtctcacctgccgccatctaagatgtgcctgcttccccttctaccatgattttaagtttcctgaggcctccccagacatgcggaactgtgagtcaataaaaattcttttatttataaattacccagttttgggcagttctttttttttttttttttttttgagacggagtctcactctgtcgcccaggctggagtgcagcggcgcgatcttggctcactatgagctccgcctcccgggttcacgccattctcctgcctcagcctcccaagtagctgggactacaggcgcccaccaccacgccaggctaattttttgtatttagtggagacggggtttcaccgtgttagctagtatggtcttgatctcctgacctcgtaatcctcccacctcagcctcccaaagtgctgggattgcaggcatgagccaccgtgcccggcctgggcagttctttatagcagtttgaaaaacgtactaatacaggacctcaggataagaactttttctcacattccttttttataggtggtctcatccattcccttttttcagcagttcccattatgccagtgattcctcaaactggatctccaacttatacctccagtgcggcgctcccacaatgcttaactccaggaaacaccattcacagtgtagccattgtgaatggcagttcttggagtagcgcactacgtagccagtgtgaccacagactgcatacttgcagctttaccctagtgcctcagaggcatcctcacacccagctcatctgatatggcactcattgtccttcctcccaacctgctcatcttcctaccttccttgccttggtgagtggcactatccatctagttacccaaaccggagatctggaagccaccaacagttctttttaaccccttgatctattattgatcattttctctttccatcaccataacacaactgtcttgtagtcataccctccatccccttcccattgctacttcctagacttaggtcatcatttatcttcttaattactatcaaagagaacatttatctcttagactactgcagtcagctctcaattgatctctctctcttttttttttgagacggagtctctgtcacccaggctggagtgcagtggtgcgatcttggctcactgcagcctccacccccagggttctagctattctcctgcctcagcctcccaagtagctgggattacaggcacctgccaccaggctcggctaattgttttgtatttttaatagagacagggtttcgccatgttggccaggctggtctcaaactcctgacctcaggtgatccacctacctcagcctcccaaagtgctaggattacaggcatgattcactgcacccagcctgatctctcttaatatccaaattcatcctcaacgctgctggaatgatctttctgatcatgtaacttttaaaaaatatttcaataacttgtctagaataaacacccagatttttaatatgacaagttttgaccttccatgatctggctgctccttactttttgtttcatccttagccaatcctttgcacccattgctttgtccttaccaaactgcttgctgttcgtggcatacatgtccatggctctgtctttgcttatattgctctactgcctagaatatctacacctgtgtttataccttttatccatctttcaggatgagacctactcatctttcagatctcaacacctgggtcatcttctctaaaaactttctgtgcctcctttcctgcttatttacagtcatgcaatcttaccccatgaaaaatagctactcctatctctctactttgtatctgttattttagggcctatcagcagtttattcatcagtcggtcacttatataatatacatgcctggccctctctacagattgtaaactccttaagaatgaggacttcattttacattcctcaccaatgtcttacatattactggtattcagatagttcgaatagtcactatttgttctttgaataattcggttacttgttactaaaagtacttttaatgattttttgattaggactttcaacaaattctctatgcatatatttgattctgttgttctgtataagctcacttttcttaaaataatatttccaaaggtaagtttcccaagaagggaatttgcacaaattgtttgttctctcttggttctgtgtcttagaggaaagtacacagcacccaggttgtcacacattgctcaagaacagtgatcacaatctattatgctcaacaggccccgctggggatttttctgaagacctgactacgttataaactcactaatattgggactgggtcttcaactgttttttgcccagtgattttttgcctgtaggtactcaatatgttgaatgaatgattttagcatatcacaggaagattgcagatttggatactgttgcacttatatatatctggaaaggattttatcttaaatatcaaggaaaaaagctaaagttagcttctactgttttagagcatttgtgcagaatgtcatcagatgaggagaaatactcacttccagttgtgcaaaatgactccagtcgaggcagttctgtctcttcgaatcttcaggtaggaaaaaatttctaaatttaccatgactttttttattttaaacaaatgaatgtaagggaaaactaggattttttaataattttttcatccatttacaagggagtttttcaatttataataatatcaaacttcaggaattactgtacacattttaggagtgactttacattgttttaacttttcagaaaatattgatgaactcttcatacactctgtacaaaggcttcaaccaacacagtaagaggtgaaacaaatgttcaagaaacatttttttgtttaaatttttttcattttagctacctctcatgaatgctactttcacttttaatgcaaattaatacaatatcaaaccatccaaagttctagagctcaagattcccttgtgttctacttgctgaggtttggtctctgttgtcacaacattcagtacaatctgctgcccaggacctggacattgacagataaaatgaagtgggtcagttaactacagagggtgtggtatttacatgaaatgttttaaatttctcttatttctaaatatttcatcatcaaaaatatggatttagatttctggagtagattttaaatatgagaataatgacatggtatatcttaaattttacagttgtattactcaaggggaaaggctgtttatgcctaagcatatgaaattgttattgattctgtacgatatgagaaaagctttaggaaaatattttatgaaacaaatttgttcctttaatcgaaattatggatttcaaaatggggaaggtattgggaaaatatctgaatatttacaggataaaactagtctggagttgtggcagagcttttgcaccctagccttcccttttgatggtacctgtcccatgtagtcctctcttcaggtgacagtacttcctccacccttcatcgctgtctgattgaaacttgaagatagaactgattaactcatttatactaaaatgtaaacaccttgtgagctctcaaatttcatttcgtgaagagataaagctttaaatcaaaagaataactctctagagtggaattttagagagacggaagaagaacctgccagaaattattttgtgttattgtttacccacctataatgtaagctcaactgagagtctattactgtcaactaatgttcctactggttcttggactgaagttgaaagcctctccatattccctgtacatacagtgttattactttgggtttcactactggaagcacttcaaaatataaatacaaaaaaaaatcttaaaaataacataaaatacacatttttacatatgtagtaaatatgtaaatccaaacatttaatacaaaagcccctcataaataaatattcctcttaaggaacttttttgttactctctttttatgcgaatgcttcataagccagaaggtggtaaatgctgagggatgggcagcatccatagtgcttatacactgaaaatttcctctaaccacagctcctatcagccaagttgctctgactctaatggttgaggcatgggtggagctatatttcagggtcatatcaattcagctcttgggggttggggaggggggcaaaattacaagttttgaatgttaacagaggttatgtttggcaattaagaaagccaatattgtttattttgattcttaattttaaattttatttttaaataacttatttggcttgtgtctacatatatgaaactctaaaatagtcatttaaataactgattttttctaaatgttttcttgaaataagttggaatatatggtcatggaatactattgacatatacttatttatttcccctttaagccatagcaattgtggtaaaatatatgaaatatatgaatatgtatgaagtatatgatttgaaatatgtgtttggatcttttttttccttctcttatccagagcagaagtcagactagggaagccacaagtgaaagccactgacttccacttctccctccgttcctacatgctagaggtggtgataggctaactctgagtagagctgacttggctaaatctagttgcaactgacaccacagcaggaacactataaaaagtttatgaacctcacaatataagatcaccatcatattaatctgctcaggctaccataacaaagtaccataaattcataggcttaaacaacagacatttatcttctcacagttctggaggctagaagtcccagatcacagcccaaaagggtcagtttctggtgagggctctctttgtggattgcagacaggtgccttcttgctgtatctttgcatggcctttcctcagtacagtatgtgcaggtgggaggagagcatgcacaaggttcctggtgtctcttctgatgagtacattaatgctctcagggccccaaccaatgaccttatttaaccttaattactttcttgaaggcctcatctccaaatacagccacactgggtgttagggcttcagcatatgaattttgaggggacacaaacattcagactccgtaactccataacagccacacttttatatattcttagccaaaatcaaaagtatattttgggtgtttgggaagtataatagtgctttaacagaaaccaagtaagggtggtttaagtgggttccttacagtttcattctgtctctcataaattctgagctgatacgtagtcctgagatcatctgaggacccaatcccttctctctttttgctgtaccatgagctgttgaccgtgtttgcattgtcaggtactggtgcactgacagtgtactaccactagcccatgggaagaggggaccagcaggaagcagcttcgtttttaaggacttcacctaaagttgtacacatcatttccagttgaatcccatagaccaggtctcttggccacacctagctgcagaggaggctgggaaatgtagctgggtggccatttgcccaaatcaaaccctggggctttattaagttaaagaaattaaaaagaaatggatgctgctggattagttacagtctctatgcacttgaaattttatgtattagtttattaggaccaacacacacattcaggtttataggaactagtaaatatcttgtgcatggccccaatttattaagctctttgggaatttctttttgataattagaaaaccaatatgctttgggaagtgtattttttttaacctaaggatatttaaatctatttaaataatcatagttacttttgtcaatgtaaaaattaaatgttggtgctcgcttcagcagcacatatactaaaactggagccacacagaaaattagcatggaccctgtgcaaggaggacatgcaaatttgtgaaatgttctataattttttaataatttttttaagttttataatataaaaaaagttgtattgtgatatcctaaatgatttgtttcctaataagagccttctgtctcagtgataaccattatgtaaaatactgatttttatttgctactaggaaatgtaagtttaaaactcagacagatgtttattctcatgaaggtgacatcactaacaaaaatggttgattatagcaatatgaaggagattctggttgaattttctaaagattttctctttgaaatatctctctcttcctcttctgtcgttagccttaaaatatataaaaatcagtatttgctatacctaatgtttactgcgtgtaagtatctatgttaaatatgtgaatcaggccgggtgcagtggctcacgcctgtaatcctagcactttgggggtccagggctgtggatcaagaggtcaggagttcaagaccagcctgaccaacatggtgaaaccccatctctactaaaagtacaaaaattaggtgggcgtggtggtacaaacctgtaattccagatactcaggaggctgaggcaggagaatcgcttgaacctgggaggcagaggttgcggtgagccaagaccatgccactgcactccagcctgggctacagagcaagactccatctcaaaaaaaaagaagaaaaaaattgtaaatcaagaaatcaaggttgaagcgcaaaccaggtcactcttgtacatgtaattgccataaaagctagcagttttcaaatatataaaagcataagcttttttaaaaaacaattttacttaaaattccgatataaaaaagcagatgaaaacaaaactacagtagtatagatttattttgtaaattcaaatgcaatcagttaataaaaacagttaagctgccttgataaatgtacatttgaaattggggggtaatagaaggccattgcagttttataaacttaagtatccagtttgcttctatattttgtttaggttacataattttttttcagttccaaaaatggtatctttttaatagcatgtctcatcttcaattaaaccaatctgacatataaaattaagtgatagaaaatttttgattcagtgttgagtcactcacagaaccttatcacctcttcatactttgttgttgtttccccagagacaggatcttgctctgtcacccaggctggggtgcagtggtgccatcttgtcttactgcagcttccagttcctaggcttaagtggtcctcctgcctcagcctcctgagtagctacaactacaggcacacaccaccacacctagcaaatttttgtaaaaaatttattgtagagatgaggtctcactttgttgctcaggcttcaagccatcctcctgcctcagcctctcaaagtgctgagtttacaggcatgagtcactgcacccagccctcttcaaactgttaatcataaatataaaaatcacacaagaagcactcgaggaactcaagcttggaataagtggtaaaactttgtaatataataagcatgggactctattatggtaattaaatttctttaaaacaaattcagttgaatatattataacattgtaactgttacactacattattgattattggcctctcttaggaagaatatgaagaactgcttcattatgctatagtgactccaaatattgaaccctgtgcttcacagtcatctcatcctaagggagaattggtgccagatgtcagaatttctacaattcatgatattcttcatagtcaaggttatatatatttttcaagatatctcttaatttaaaatattactgagtttattaatgatactgacaggattgtgaaaatgcctgtccagatcagtgattcttctcaaccatttatgtgtattagtatcatctaggggagctttttacattttaatatattattcctgactctcgtgtgacagcttgatttttctttgaacttcatttgactcttacttttatgaagaataataaagttgaagcaatgctatggcaactgcatggctttttggtatgttgtatctcagtacttgttccaacagttttatgccaggattaacctgaaaactaaatgcccaagactaaaattaaagatggtaaccctgagagtctcttaaattactttacaaacctcatgctagtgctttatcagcagtatttatatgggcatggaggactgtttgaataattatcacaaggtgaacccatctgtggaccatgtcagcaacagaactgaaagctactataaaccaggatgtgtgttgatagatgagtgaaaagtggagaaaagaggataaagctccttttacctccattccttattcaggtgaagacaacatcccaaactctaaataaatgttctttcaaagggcacagaaagccttcctaaaacagtcctgataaggaccagttatcacactataggcgtaactccaaggatccctgtccttgaaggcgcatgacatagcctactcagaggccaaaggctcctgggcttctgctaagtcatagctctagtgtctgttgtctctcattctctgtagacgtggatttttcactgttcctctgtctttggcctgttgcagtggaacaacaaacaggaccacaggatgagagccttaaaatacaggccaggcagtggctcatgcttgtaatgccagtactttcagaggctgaggcaggaggattgcttgagcccaggaggttgagacaagcctaggcaacatagcaaaaccctagctctacaaaaaaattagccgggcagagcagcctatagtcccagcaccttgggaggctggggtgggaggattgcatgagctcaggagttcaaggctgcagtgtgccatgattatgccactgcacttcagcctaggcaacagagcaagactctgtttaaaaaaaaaaaaagaaaaaactttcgagatgctgtagtcaacagttcaaggtaatcatctgggatttaagaccattgttcttttctcttatgtaagatagcatttatttattctctgccatttccaaaaaggatttgagattaaaacatacgttatatagtaagtttagatatcctttagtcatcttgattcacaagtagactttgttaaagtcttctatgtaaattcatcatcccacattctctttattcttggtatctcagttgcttgatagaaggcatggtatgtggaaattggcaaagtatgtgtaagcctctaacagtcattcttgagaggtttttcccagtttcctttttgccatctgttgactacaggttcctgaagtggaagcaaatgttttgggggagccagtgccacttgagtttgattgtggctagtgaaaagcagcgggcctctggaaatacccagtgtcataagagagcagatccttttctaagttctaatgtcattcacccacttattctcttagtgtgaattgaatgctatagtagactacattatctctcatctatatttggtgcataagttggagcttatcaatgatatagtaagtctttttctagtctcagatttttatctgttcttgtcctttgttttagtgttcctatatccccagcatgttgtattttgtttgttctaaaatattatgtactgctaccttcttaaattatgtgtgattagacattttatttaagagtggttcagtttaattttaaaaagctttctttttggcaggaaataactctgaagtaagagaaactgcaatagaagttggaaaaggatgtgatttccatatttcaagtcattcaaagacagatggtatgatttttctttagcttatttgtattaatatacaacattttgtggtttgatgaatattatctatgtagtaagaggaataatttcagcatattatttattagcaggattttaaaatgctattattgctaatttaagtgataatatttaaaataatttgataagataccaaaatagtacaattaagacaggtcaatgcattatagtgtgtagtatcctttcttaaaattgctaagttagagggcaagtcttttaaaagatttaatgggatattagatagtttggccaattcaagtttttatgtaaaccaatgcactgtttcccaactttcaggcatttgcgtaccagtgtaaggattttcatcctatctttatgccacctgttacgccatcatttagtgtttttctttaaaagtctgctttgtctttgttaaaagggaagattagcaaatcttaaagaggctttttggggggattgttttttgtatttttttaattttgtttggtttttgagacaggatctcactctgtcacccaggctagagtgcagggctccctgcagcctcaacctccttggctcaagtgatcctcctgcctcagcgccccctcccccagtagctgggactacaggcacatgccaccacacctagctaatttttaacttttctgtagaggtgggatctcactatgttgcccaggctggtctcaaactcctaagatcaagtgatccacttgccctggcctcccaaagtgctgggattacaggcatgagccaccatgcctggctttaaagaacttttaaaagcatactagaactggactgagacttttttcttgactagtcagaataattaattaaaatgtaatattgtggaatatttttctatttaatgttatttaatgtggtaaccatttttgtcaccacgtaagtaatgcctctaacccttagtttcctcacttgtaagtagaagtcttaggcatcataatctctgacagcccttacaagttctgaagttacatgatttgatttcttaaaaggtaagtgttgagatattttttaaattgaaaagcagagtctatcgctttctttgtgagtacagatctagttggcaaaatcaagtaaaagagaatattcatgtacattgtcattccacctgttctttgggtttcttaaccatcctcagaacatgcagatagcatttcatagtatgactagcccagaccttgtgttatgttttttataccaaacacacatgttagggaattattttcccttttgcaaagaagtctttacataagcagaatatgtttgcaaaaaaactaaaatcttacaaattttaaaaaagaattcttgaaagatttaagtaacaagttctctatcatagattcatctttccttcagtaggaagaaagctcttccatctttgttattaggatgctcgtagcaaatgtgagatatgtgacaagtgatgacagatagtctctaattccagcataaatatgtgagaaaatattaacttttctttctcagtgctttttttttttttttttgagacagagtctcgctctatcacccaggctagagtgggtggcacgatctcggctcactgaaacctctgcttcccgggttcaagcaattctcctgcctcagcctcccaagtagctgggactataggcacgtgccaccatgcctggctaattttttgtatttttagtagagatagggttttaccatgttggccaggctggtcttgaactcctgacctcatgattcgcccacttcagcctcccaaagtgcggggattacaggcatgagccaccgtgcccagcctttcagtgcttttttagaaatagatacctgttctctttagggccctgactctcccccacctccctggatatgggcaggggatgagcgttttatatatatgcacatacatatagagatgtgtacatttctcacctctacattgaagcctaacagtgtacttaacaacagagtatctgcaaaactaaattatgagtctctttctacttaaattgtttaattttaataggttttttgtttgtttttgtttttggagacagagtctcattctgtcacaggctggagtgcagtggcacgatctcggctcactgcaacctctgcctccctggttcaagcaattctcctgcctcagcttcccgagtagctgggactataggtgcgtgccaccacacccagctaatttttgtatttttagtagagatggggtttcaccttgttggccaggatggtctcaatctctggacctcatgattcacccgcctcggcctcccaaagtgctaggattacaggcatgagccaccgcgcccggccgaattttaatagtattaaaaccaatcccagtgttaaacttacagagtaatattgacctatatacaaccacactgaccttggtcaattacttaactttttctgaacctcagtttctcatcagtaaaatggagataataatacctattttttagggtagcatgtgttatgagaactaatctttataatgtttttattacagaaacagaaagcacttcattaatggtgatatgatacagatgatgatagtttcacctcaggctggacctggatatatgaaggatccttatctgggatagaggtcatttgctgggagagaagggattgggagtataggaggtatctcatgccagtctgtgctaaatcactgacaatactgaaattaaaaatagattaaggtacacctgaaaggtagtttctctgcattttttctcagcctccataagtagcagacgtcttttagccttccagtatggttccttaccaacttgagttattttcaatttggcttgacagctacaacttttcttttattcagagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaaggtacggtacagcagttcttcaattacagttgtttagtatgtaatgtaatagttttactctcatttatactgttttgtttttttgagttaaactttctaaaaatcttttgtttcctgagatcagtttagtgtcttaagtcttgcttctcaatctttaatgtacttacgaatcatagcgggagcctgttaaactacagcttcatatgcagtaggtcttcagcagggcctaagatcgtgcttctttttttctttttttgactcttgtttgtttgtttgattttactttaagttctgggatacatgtggtgaacatgcaggtttgttacataggtatacatgtgccatggtggtttgctgcacctatcaacctgtcatctaggtttcaagccccacatgcattaggtatgtgtcctaatgctctccctccccttaccctccaccccctgacaggccccggtgtgtgatgttcccctccatgtgtccatgtgttctcatttctgtcaagctcccaggtgttgctactggttcagaaactgtactttgagttgccaggttttaagtggttgctggaacggttctacatgctccattgaatttcacagatactttgaatggctcagcctgtgtgtaactgagacatactgtgcctttaccatatcgtagttgtgactaatagaaatgtctccttttatgcaataacgaaagatccaattttagcaatggatattcattttatagccactcctatagcaactatgatgtgtaagtgataaaactataaaagttgatttttattttgatactactggcctttaagtaaaacaaagtattgcagaaatagtaagtgggttttatttatttatttatttatttatttttattattattatactttaagttttagggtacatgtacacaatgtgcaggttagttacatatgtatacatgtgccatgctggtgcgctgcacccactaactcatcatctagcattaggtatatctcccaagtgctatccctccccccatcccccccaacacaacaacagtccccagagatgtgatgtccccttcctgtgtccatgtgttctccttgttcaattcccacctatcagtgagaatatgcggtgttgggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagccgcatgatttatagtcctttgggtatataccccgtaatgggatggctgggtcaaatggtatttgtagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgcttttttcttgtaaatttgtttgagttcattgtagattctggatattagccctttgtcagataagtaggttgtgaaaattttctcccgttttgtaggttgcctgttcactctgatggtagtttgttttgctgtgcagaagctctttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttcctcattgcttgtttttctcaggtttgtcaaagatcagatagttgtagataagcggcattatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatactgactcttcctacccatgagcatggaatgttcttccatttgtttgtatcctcttttatttccttgagcagtggtctgtagttctccttgaagaggtccttcccatcccttgtaagttggattcctaggtattttattctctttgaagcaattatgaatgggagttcactcatgatttggctctctgtttgtctgttgttgatgtataagaatgcttgtgatttttgtacattgattttgtatcctgagactttgctgaagttgcttatcagcttaaggagattttgggctgagacaatggggttttctagatatacaatcatgtcgtctgcaaacagggagaatttgacttcctcttttcctaattgaataccctttatttccttctcctgcctgattgccctggccagaacttccaacactatgttgaataggagtggtgagagagggcatccctgtcttgtaccagttttcaaagggaatgcttccagtttttgcccattcagtatgatattggctgtgggtttgtcatagatagctcttattattttgagatacatcccatcaatacctaatttattgagagattttagcatgaagggttgttgaattttgtcaaaggccttttctgcatctattgagataatcatgtggtttttgtctttggttctgtttatatgctggattacattattgatttgtgtatattgaaccagccttgcatcccagggatgaagcccacttgatcatggtggataagctttttgatgtgctgctggattcggtttgccagtattttgttgaggatttttgcatcaatgttcatcaaggatattggtctaaaattctcttttttggttgtgtctctgcccggctttggtatcaggatgatgttggcctcataaaatgagttagggaggattccctctttttctattgattggaatagtttcagaaggaatggtaccagttcttccttgtacctctggtagaattcagctgtgaatccatctggtcctggactctttttcattggtaagctattgattattgccacaatatcagctcctgttattggtctattcagagattcaacttcttcctggtttagtcttgggagagtgtatgtgtcgaggaatttatccatttcttctagattttctagtttatttgcatagaggtgtttgtagtattctctgatggtactttgtatttctgtgggattggtggtgatatcccctttatcattttttattgcatctatttgattcttctcgcttttcttctttattagtcttgctagcagtctatcaattttgttcatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctcctttctcttgtgggcatttagtgctataaatttccctctacacactgcattgaatgtgtcccagagatcctggtatgatgtgtctttgttctcggtggtttcaaagaacatctttatttctgccttcatttcattatgtacccagtagtcattcaggagcaggttgttcagtttccatgcagttgagcggttttgagtgagattcttaatcctgagttctattttgattgcatgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatatctattaggtctgcttggtgcagagctgagttcaattcctgggtatccttgttgactttctgtctcgttgatctgtctaatgttgacagtggggtgttaaagtctcccattattaatatgtgggagtctaagtctctttgtaggtcactcaggacttgctttatgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcccgtgagatgggtttcctgaatacagcacactgatggatcttgactctttatccaatttgccagtctgtgtcttttaattggagcatttagcccatttacatttaaagttaatattgttatgtgtgaatttgatcctgacaggatcaatgacattatgatgttagctgattattttgctcgttagttgatgcagtttcttcctagtctcgatggtctttacattttggcatgtttttgcagtgggtgttaccggttgttcctttccatgtttagcacttccttcaggagctcttttagggcaggcctggtggtgacaaaatctctcagctttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatcagctgttagtctgatgggcttccctttgagggtaacccgacctttctctctggctgcccttaacattttttccttcatttcaactttggcgaatctgacaattatgtgtcttggtgttgctcttctcgaggagtatctttgtggcgttctctgtatttcctgaatctgagcgttggcctgccttgctagattagggaagttctcctggattaatatcctgcagagtgttttccaacttggttccattctccccatcactttcaggtacaccaatgagacgtagatttggtcttttcacgtagtcccatatttcttggaggctttgctcgtttctttttattcttttttctctaaacttcccttcttgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcggagtaatttgatcgtctgaagccttctcagctcgtcaaagtcattctccatccagctttgttccgttgctggtgaggaactgcgatcctttggaggaggagagtcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtacccggccgtgtgaggtgtcagtctgcctctgctggggggtgcctcccagttaggctgctcggaggtcaggggtcagggacccacttgaggcaggctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggtctccttcagctgtggtgggctccacccagttcgagcttccgggctgctttgtttacctaagcaagcctgggcaatggcgggtgcccctcccccagcctcgctgccgccttgcagtttgatctcagactactgtgctagtaatcagtgagacttcgtgggcgtaggaccctctgagccaggtgagggatataatcttctgttgcgccgttttttaagcccctcggaaaagcgcagtattcgggtgggagtgacccgattttccaggtgccatctgtcacccctttctttgactaggaaagggtactccctgaccccttgcacttcctgagtaaggcaatgcctcgccctgcttcacctcgcgcacggtgcatgcacccactgtcctgcgcccactgtctggcactccctagtgagatgaacccggtacctcagatggaaatgcagaaatcacccgtcttctgcattgctcacgctgggagctgtagactggagctgttcctattcggccatcttggctcctcccccacttttttttgtttgtttttttgttttttgttttttttgctattattaaaaaactggagaaaatgacagtttttctgaaacatataatttgagaaaactaagttgcatattcacatatatagagaaattatggcccatgtgagttctgtggcatttatatttttccctcatttggaaccttaaattctagaaataattcttcagcatggttttaccattttccccccttggaacaggtttcatacttagaatagtgtaagtcaattggagtgttataccaccaaccatttaaattgtgtttagttaatatgttgtccagtttttttttaataacaaattattatttggtctttttatttgtgccagtcagtagggtgacagaacatagcagtccattataacagataataatctgtgataaatggcttgggaaaacaagtatcaactctcatggtttctttccactatcacccatttctaaataacttcccagtcagtatggcttagcctatgccatagttatgtgtttccctttattcctgatccatcttcatatggacatttaatccttgaataaacaaaggaacatagtgaatgagacctgaaatttttttaagtgacaacaagatttcatacaaaattagttaaaataggaaaaaattagcttccctagtatgatgaatgtgaactgcacagacctgtgactgttgaacttacatatgtttttcattaatgtgttccaattgttttaatgacttttgtgttgatgcttgttctgatttttttaatgtttctttatttcagtgtagttttaagaagtgatattaacgaacaaactacttaattgtcactatattaatttttcagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtcttcttttttatatttctttttaactgagattcagtaaatgtcttgctagataataaattctaagaaatgattatttacctcatacaagatacaggttctatcagaaactgacagaaaaattcatagccattggatttattcttcctattaaacatatcagcataatgtcattttaccctcaccattgacttctgtgttcttgatgttttaagagtgtttgctttgtaaactacattaaaacatcaccttgtaacccataaatgtataaaactattatgatttgtcaatttaaaaaaaatttttttttaaaaagagtatgtgctaaatgtaagtacactagtttttttctttctaatcctttcttcctaaccttaagcgaacgtgaaggaacgagcattatctacattttaaaccatccttttaggggtcattttaaggatctcacattctttttttaatctctctctttttgaaacagggtcttgctatgttgcccagagtggagagcagtggctattcataggcataatcatagctcactacaatctcaaactccggggctcaagtgaacctcctgcctcagcccctgccagggactgcaagtgcataccaccatgcttgggtttaagcatctcaaattctatctgtgatggatgtgttttcattaatgaaggctttcttcattttattgataaacacagaaaacatcttttatttcactttcctttagcttcttaagaattcgagggtaagattcaagtctgtgctaattttttgcctcctgacacagtacctggagcaaagcagatgggcaacaaatctgtgcccggctataaatggatgtccggaggggcatccacttatggataggagagtggtgttgttcagaagaggaggacttgggcagacacctcagctgcttgtctgcagaagtagcacttaagtgttttcatgaattaaagattataatttttttaaacataccttgatttcgtataaaattgaacattttatagaattttttttgaaacaatggattttaatgtcagtcattttctttgttatactcaaaattctgtcccatggtttttaagtttaatttttttattttgaagtatcacaaagaatatagatatcatatgttcagtttatgagaatgagtaaagtggatagacaggtactacgattcagcttaacacatagaatatttccagtagcttagaatgtatgcccttttcctctctggaaattatttaaagagcagttataaatatctcttggtaaatgtgcccaatttacaaaatctctttctaatgtgactatttttagaaatttatttcagttattcagttcttttataagagagaatattatcttaggattttaaagccttctgaatttttttttaagaacaagagtaataatatcactgaagaagtacatcaacatataacattaataacattagttatatataatgttattaatatgttatatgtataacattaattatatatatttacttatatatataacattttatgtatgacatatgttatatatgttattaatagttatatgtataacatgttattaataggtatatataacatatataatatatagttatatatataactataacatattaatagttacatatataactattatttgcttttataggtttgtttaatccagaaaatcattggacagtcgttgaggaacttctatatccaagatagtagtagggaccagaaagatatttaaatatctaaatattctggcccctgccctcaaatctagtgaataaagacatggtgtatataggagaactttcaaatgtataattgttttacctgaattgaatgtcagtagctaatttgcatatacataaactttttattggtgattaccatatacacataatgaagacttccttcttcttttgttccctttcattagttgatatctagtatattcatgtgagaaagttttaccatctttttaaagataataatgaggttaactgaatgaatatagtagtgatccatacctatcctctctagcattttttgatatatgagaaaatcactttaccattgctgttattttaatatcacataattgggttaattgctgtttacaggtgatttctagcttgtctcatgccataggcaagcaaaggaaaagatagagttgatgagaacattcttccactggcgaatcggccatgtcagagccagacaggatgt

SEQ ID NO: 12680 - DNA, 7441 bp, Homo sapiens
tatttttagtacagacagggtttcaccatgttgaccaagctggtcttgaactcctgacctcaggtgatctgcctgccttggcctcccaaagtgctgggattacaggcatgagccaccacatccagccggcattgctgttttccttgtggcaattttaagtcaagtcaagactgattcagggtcttcctgttgatataagggtgtgaggaagatggttgtggcaggtgctatgagaggctgacctcataaaagttgtatgaatcattcagacaacactcctgccttgttatattggtcaaagccaaccataggcctgcccgcattcaagggaagggatatgagtctacctcagcctgctcctgactcagttctgtttgcctcagaactcagctactctcccttgggattcgctgcatcccaactgcctctatcctcctcagtcatggtaatcattcactcactcattcaatcgttcaacaaatattaattgagcatctaccctgtgcctgatactatgctaggcactgaatatatagcagtaaaccaggtggcataagactgtccccagggagcttccatcctaaagaaggagagagaaaataaagacataaatgaggacactctacgtggtgtgtcaggcatgatatgtgggctcatacctgtaattccagcactctgggaggccgaggtgggaggattgcttgagcccaagagtttgagactagccaggacaacataagaagaccttgtctctatgagaaaaaaaaaatagccaggcatggtggcacatgcctgtggtcccagctactcgggaagctgaggtgggaggatcgcttgagaccaggagatggagggtgcagtgagctatgaccttgctactgcacaccagccactccagcctggatgagatagtgagatgctgtctcaaaaacaaaaacaaagcaaagtagaaaacatggataaggagtggtagagacagggttggacctgcaatttgaaatagatggttagggggtgtggaacaagccagccacatggctatctggataagggtgtccctgttagggcagggaaatgtgcgaaagccctgagcagtggggcctgtgcagagggttcaagatgcgggaggacaaggcggagcaggggaagaggtatagtcagatgacgtggggcccaggggaaagacctggggttcagtctgagtgagattaccggccagtaagggatttgggcagaggagcaacaggattcgactaaggccagcagtctgatgtaagctgtggattcgtgcacctgctttgtgtgcaaatcacctattttcctgggtaaaaccattagcattagaggctagagccgtgaagctgagcataccctttcacttaataattccatgcctgggaattcaacctggagagagaatttaataaaacagtattcttcaggagtctcaagttttcaataagaagtttttaaattttgtgtttttaacaataaccttttaaaataatggtgaacatatattccactgtctggttgattacttatatctcaataccacatttcattccagcagcagagttaagtagtattgctttaattgcaacaagctgagctaatgtgggaagaatgcagtagagtggcacagaagaatggtgagttcattgttattaccctcctagcccgtgagaacgcccaccatcccatgagttcctacatctatgccatgaggagcagttgggtttcagcacagcattctctatctttgcaaagttgttgattttaaccctgtgttttgaagttgtgctttgatttaattagcaatttcattttgatgggatagttatatcagtcataccccttctacttagttttatgtccataatattataattaaacattatttaattcaacattgaagggcagtgaaataattattttctgttttttctttttttctttttaattattatactttaagttttagggtacatgtgcacattgtgcaggttagttacatatgtatacatgtgacatgctggtgcactgcacccactaactcgtcatctagcattaggtatatctcccaatgctatccctctcctctcccccgaccccacaacagtccccagactgtgatgttccccctcctgtgtccatgtgttcccattgttcagttcccacctatgagtgagaatatgcggtgtttggttttttgttcttgcgacagtttactgagaatgatgatttccaatttcatccatgtccctacaaaggacatgaactcatcattttttatggctgcgtagtattccatggtgtatatgtgccacattttcttaatccagtctatcattgttggacatttgggttggttccaagtctttgctatcgtgaatagtgccacaataaacacacgtgtgcatgtatctttatagcagcatgatttatagtcctttgggtatatacccagtaatgggatggctgggtcaaatggtatttctagttctagatccctgaggaatcgccacactgacttccacaatggttgaaccagtttatagtcccaccaacagtgtaaaagtgttcctatttctccacatcctctccagcacctgttgtttcctgactttttaatgatcgccattccagctggtatgagatggtatctcattgtggctttgatttgcatttctctgatggccagtgatgatgagcattttttcatgtgtctgttggctgcataaatgtcttcttttgagaagtgtctgttcatatccttcgcccactttttggtggggttgtttgttttttccttgtaaatgtgtttgagttcattgtagattctggatattagccctttgtcagatgagtaggttgcaaaaattttctctcattctgtaggttgcctgttcactctgatggtagtttcttttgctgtgcagaagctctttagtttaattagatcccatttgtcaattttggcttttttttgccattgcttttggtgttttagacatgaagtccttgctcgtgcctatgtcctgaatggtaatgcctaggttttcttctagggtttttatggttttaggtctaacgtttaagtctttaatccatcttgaattgatttttgtataaggtgtaaggaagggatccagtttcagctttctacacatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggtgactgtagccttgtagtatagtttgaagtcaggtagcgtgacgcctccagctttgttcttttggcttaggattgacttggcgatgtgggctcttttttggttccatatgaactttaaagtagttttttccaattctgtgaagaaagtcgatggtagcttgatggggatggcattgaatctataaattaccttgggcggtatggccattttcatgatattgattcttcctatccatgagcatggaatgttcttccatttgtttgtatcctctttaatttcattgagcagtggtttgtagttctccttgaagaggtccttcacatcccttgtaagttggattcctaggtattttattctctttgaagcaattgtgaatgggagttcactcatgatttggttctctgtttgtctgttattggtgtatgagaatgcttatgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgtgtttgtcatagatagctcttattattttgagatacgtcccatcaatacctaatttattgagagtttttagcatgaagggtttttgaattttgtcaaaggccttttctgcatctattgagataatcatgtggtttttgtctttggttctgtttatatgctggattatatttattgatttgcatatattgaaccatcgttgcatcccagggatgaagcccacttgatcatggtggataagctttttgatgtgctgctggattcggtttgccagtattttattgaggatttttgcatcaatgttcatcaaggatattggtctaaaattctcttttttgtttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttttatttctgtgggatcggtggtgatatcccctttatcattttttattgtgtctgtttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttttctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcagattgttcagtttccatgtagttgagcagttttgagtgagtttcttaatcctgagttctagtttgattgcactgtggtctgagagatagtttgttataatttctgatcttttacatttgctgaggagagctttacttccaactacgtggtcaattttggaataggtgtggtgtggtgctgaaaaaaatgtatactgttgatttggggtggagagttctgtagatgtctattaggtccacttggtgcagagctgagttcaattcctgggtatccttgttgactttctgtctcattgatctgtctaatgttgacagtggggtgttaaagtctcccattattaatgtgtgggagtctaagtctctttgtagtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttgtaattggagcatttagtccatttacatttaaagttaatattgttatgtgtgaatttgaacctgtcatgatgatgttagctggttattttgcccattaattgatgcagtttcttcatagcatcgatggtctttacattttggcatgattttgcagtggctggtactggttgttcctttccatgtttagtgcttccttcaggagctcttttagggcaggcctggtggtgacaaaatctctcaacatttgcttgtctgtaaaggattttatttctccttcacttatgaagcttagtttggctggatatgaaattctgggttgaaaattcttttctttaagaatattgaatattggcccccactctcttctgtcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctaccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattattttttctctaaacttcccttcttgcttcatttcattcatttcatcttccatcgctgataccctttcttccagttgatcacatcggctcctgaggcttctgcattcttcacgtagttctcgagccttggctttcagctccatcagctcctttaagcacttctctgtattggttattctagttatacattcgtctaaatttttttcagtttttaacttctttgcctttggtttgaatttcctcctgtagctcgtagtttgatcgtctgaagccttcttctctcaactcgtcaaagtcattctccgtccagctttgttccattgctggtgaggaactgcgatcctttggaggaggagaggtgctctgctttttagagtttccagtttttctgctctgttttttccccatctttttggttttatctacttttggtctttgatgatggtgatctccagatgcgtttttggtgtggatgtcctttctgtttgttagttttccttctaacgacaggaccctcagctgcaggtctgttggagtttgctagaggtccactccagaccctgtttgcctgggtatcagcagcggtgtctgcagaacagtggttttttgtgaaccgcgaatgctgctctctgatcgttcttctggaagttttgtctcagaggagtacccggccgtgtgaggtgtcagtctgcccctgctggggggggtgcttcccagttaggctgctcagggggtcagggtcagggacccacttgaggaggcagtctgcccgttctca

SEQ ID NO: 12681 - DNA, 8739 bp, Homo sapiens
  misc_feature (149)..(149): n equals a,t,g, or c
  misc_feature (5447)..(5447): n equals a,t,g, or c
ttttatttatttatttttaattttatttttattttattatactttaagggtacatctgcacaacgtgcaggttagttacatatgtatacatgtgccatgttggtgtgctacacccagtaactcgtcatttaacattaggtatatctccntaatgtaatcccttcccccctcccccaccccataacaggccccagtgtatggtgttccccttcctgtgtccatgtgttctcattgttcaactcccacctatgagtgagaacatgcggtgtttggttttttgtccttgcgatagtttgctgagaatgatggtttccagcttcatccatgtccctacaaaggacatgaactcatcattttttatggctgcatagtattacatggtgtatatgtgccacattttcttaatccagtctatcattgttggacatttgggttggttctaagtctttgctattgtgaatagtgccacaataaacatacgtgtgcatgtgcctttatagcagcatgatttattatcctttgggtatatacccagtaatgggatggctgggtcaaatggtatttctagttctagaaccttgaggaatcaccacactgtcttccacaatggttgaactagtttacagttccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgtcttttggctgcataaatgtcttcttttgagaagtgtctgttcatatcctttgcccacttgttgatggggttgtttggtttttttcttgtaaatttgtttgagttcattgtagattctggatattagccctttgtcagatgagtagattgcaaaaattttctcccattctgtaggtcgcctgttcactctgttcactctgattcactctgttcattctgttcactctgatggtagtttcttttgctgtgcagaagctctttagtttaattagatcccatttgtcaattttagcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaaggaatccagtttcagctttctacatatggctagccagttttcccagcaccatttattaaatagggaatcctttccccatttcttgtttttgtcaggtttgtcaaagatcagatggttgttgatatgtggcattatttctgagggctctgttctgttccattgttctatgtatctgttttggtaccagtaccatgctgttttggttactgtagccttgtagtatagtttgaagtcaggtagcatgatgccttcagctttgttcttttggcttaggattgacttggcaatgcgggctcttttttggttccatatgaactttaaagtagatttttccaattctgtgaagaaagtcagtggtagcttgatggggatggcattgaatctataaattaccttgggtagtatggccattttcacgatattgattcttcctacccatgagcatggaacgttcttccatttgtttgtatcctcttttatttcattgagcagtggttggtagttctccttgaagaggtccttcacgttccttgtaagtgggattcctgggttttttatctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctgattgccctggccagaacttccaatactatgttgaataggagtggtgagagagggcatccctgtcttgtgccaggtttcaaagggaatgcttccagtttttgcccattcagtatgatattggctgtgggtttgtcataaatagctcttattattttgagatatgtcccatcaatacctaatttattgagcgattttagcatgaagggttgttgaattttgtcaaaggccttttctgcatctattgagataattatatggtttttgtctttggttctgtttatatgccggattacatttattgatttgtgtatgttgaaccagccttgcatcccagggataaagcccacttgactatggtggataagctttttgatgtgctgctggattccatttgccagtattttattgaggatttttgcatcgatgttcatcagggatattggtctaaaattctctttttttgttgtgtctctgtcaggctttggtatcaggatggtgctggcctcataaaatgagttaggaaggattccctctttttctattgattggaatagtttcagaaggaatggtaccagctcctccttgtacctctggtagaatttggctgtgaatccatctggtcctggactttttttggttggtaagctattaattattgcctcaatttcagagcctattattggtctattcagagattcaacttcttcctggtttagtcttgggagggtgtatgtgttgaggaatttatccatttcttctagattttctagtttatttgcgtagaggtgtttatagtattctccgatggtagtttgtatttctgtgggatctgtggtgatatcccctttatcattttttgttgcgtctatttgattcttctctcttttcttctttattagtcttgctagtggtctatcaattttgttgatcttttcaaaaaaccagctcctggattcattgatttttttgaagggttttttgtgtctctatttccttcagttctgctctgatcttagttatttcttgccttttgctagcttttgaatgtgtttgctcttgcttctctagttctttttttttttttttaatttttttagtatttattgatcattcttgggtttttctcggagagggggatttggcagggtcataggacaatagtggagagaaggtcagcagataaacatgtgaacaaaggtctctggttttcctaggcagaggaccctgcggccttccgcagtgtttgcgtccatgggtacttgaaattaggaagtggtgatgactcttaaggagcatgctgcctttaagcatctgtttaacaaagcacatcttgcaccgcccttaatccatttaaccctgagttgacacagcacgtttcagagagcaaggggttgggggtaaggttatagattaacagcatcccaaggcagaagaatttttcttagtacagaacaaaatggagtctcctatgtctacttctttctacacagacacagtaacaatctgatctttctttcttttccccacatttcccccttttctatttgacaaaaccgccatcgtcatcatggcttgttctcaatgagctgttgggtacacctcccagacagggtggcggccgggcagaagggctcctcacttcccagacatggcggctgggcagagggtctccccaccccccgagacggggcggccgggcagaggcgctcctcagttcccagacggggtcgcggccgggcagaggcactcctcacctcccagatggggtggcggccaggtagagatgctcctcacctcccagacagggcggccgggcagaggcgctcctcacatcccagatggggcggccgggcataggtgctccccacatcccagacaatgggcagccaggcagagacgctcctcacttcctagacaggatgacggcctggaagaggcactcctcacttcccagactgggcggctgggcagaggggctcctcacatcccagatgatgggcggccaggcagagacgctcctcacttcccagacggggtggcggccgggaagaggcactcctcacttcccagactgggcggctgggcagaggggctccctcacatcccagacgatggggcgggcctggcagagacgctcctcacttcctagatggggtggtggccgggcagaggctgcaatctcagcactttgggaggccaaggcaggcggctgggaggtggaggttgtagcgagccgagatcatgccactgcactccagcttgggcagcattgagcactgagtgagcaagactctgtctgcaatcccggcacctcgggaggccgaggcaggcagatcactcgaggtcaggagttggagagcagcccggccaacatggcgaaaccccgtctccaccaaaaaatacaaaaaccagtcaggcgtggcagcgcacacctgcaatcccaggcactcagcaggctgaggcaggagaatcaggcagggaggttgcagtgagccgagatcgcggcagtacagtccagccttggcaacagagggagactgtggccaagtgggagacggagacgagggagagggggagaccgtgaaaagggagagggagagggagctctagttcttttaattgtgatgttaaggtgtcaattttagatctttcctgctttctcttgtgggcatttagtgctataaatttccctctacacactgctttaaatgtgtcccagagattctggtatattgtgtctttgttctcattggtttcaaagaacatctttatttctgccttcattttgttatgtacccagtagtcattcaggagcaggttgttcagtttccatgtagttgagtggttttgagtgagtttcttaatcctgagttctagtttgattgcactgtggtctgagagacagtttgttataatttctattcttttacatttgctgaggagtgctttacttccaactatgtggtcgattttggaataggtgtggtgtggtgctgagaagaaagtacattctattgctttggggtggagagttctgtagatgtctattaggtccgcttggtgcagagctgagttcaattcctggatatccttcttaattttctgtctcgttgatctgtctaatgttgacagtggggtgttaaagtctcccattattattgtgtgggagtctaagtctctttgtaggtctctaaggacttgctttatgaatctgggtgctcctgtattggatgcatatatatttaacatagttagctcttcttgttgaattgatgcctttaccattatgtaatggccttctttgtctcttttgatctttgttggtttaaagtctgttttatcagagactaggattgcaacccctgccttttttgttttccatntgcttagtagatcttcctccatcccttaattttgagcctatgtgtgtctctgcatgtgagatgggcttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttataatttggcatgattttgcagtggctggtaccggttgttcctttccatgtttattgcttccttcaggagctcttgtaggacaggcctggtggtgacaaaatctctcagcatttgcttgtctgtaaaggattttatttctccttcacttatgaagcttagtttggctggatgtgaaattctgggttgaaaattcttttctttaagaatgttgaatattgccccccactctcttctggtttgtagagtttctgctgagagatgagctgttagtctgatgggcttccctttgtaggtaacccgacctttctctctggctgcccttaacattttttccttcatttcaactttgatgaatctgacaattatgtgtcttggagttgctcttctcgaggagtatctttgtggcattctctgtatttcctgagtttgaatgttggcctgccttgctagattggggaagttctcctggataatatactgcagagtgttttccagcttggttccattctccccgtcactttcaggtacatcaatcagacgtagatttggtcttttcacatagtcccatgtttcttggaggctttgttcatttctttttattcttttttctctaaacttctcttctcacttcatttcattcatttgatcttccatcactgataccctttcttccagttgatcgaatcggctactgaggcttgtgcattcgtcatgtagttgtcgtgccttggttttcagctccatcaggtcctttaaggacttctctgcattggttattctagttagtcattcgtctaattttttttcaaggtttttaacttctttgccttgggttcaaacttcctcctttagctcggagtagtttgatcttctgaagtcttcttctctcaactcgtcaaagtcattttccgtccagctttgttccattgctggtgaggagctgcattgctttggaggaggagaggtgctctgatttttagagtttccagtttttctgctctgtttcttccccatctttgtggttttatctaccttttgtctttgatgatgatgatgtacagatggggttttggtgtggatgtccttcctgtttgttagttttccttctaacagacaggaccctcagctgcaggtctgttggagttcgctggaggtccactccagaccctgtttgcctgggtatcagcagcagaggctgcagaacagcggatattggtgcacagcaaatgttgctgcccgatcattcttctggaagttttgtctcagaggagtacccggctgtgtgagatgtcagtctgcccctactgggaggtgcctcccagttaggctactcgggggtcagggacccacttgaggaggcagtctgccagttctcagatctccagctgcgagctgggagaaccactactctatccaaagctgtcagacagggacatttaagtctgcagaggattctgctgccttttgtttggctatgccctgcccctagagctagagtctacagagacaggcaggcttccttgagctgcggtgggctccacccagttcgagcttcctggccgctttgtttacctactcaagcctcagcaatgtcgggcgcccctcccacagcctcgctgccgccttgcagtttgatctcagacttctgtgctagcaaagagcaaggctccatgggcgtaggaccctccaagccaggtgcgggatataatctcctggtgtgctgtttgctaagggtgtttgaaaagtgcagtgttagggtgggagtgacccgattttccaggtgctgtctgtcacccctttctttgactaggaaagggaattccctgaccctttgtgcttcccgggtgaggcgatgccttgccctgcttcggctcacgctcggtgcgctgcacccactgtcctgcacccactttccgacactccccagtgagatgaacctcgtacctcagttggaaatgcagaaatcacccgtcttctgcgttgctcatgcagggagttgtagactggagctgttcctatttggccatcttggctccacccctatttatttttattatttatttattttttgagacggagtcttgctctgtcgcccatgctggagtgcagtggcacaatctcagctcactgcaagctctgcctcctgggctcacgccattctcctgcctcagcctcccaagtagctaggactacagtcacctgccaccacccctggctaatttttttttgtatttttagtagagacggggtttcactgtgttagccactgtgtggatctcctgacctcgtgatccacccgcctctgcctcccaaagtgctgggattacaggcatgagtcaccgcgcttggccttattttatttatttttattacatgtcagcttatgctacctactagtggctttggcttggacctaccaggctgatggggaaaatgacattaaaagggggtgtttctggtttcacagtttaagagcaatttctaccatgctggatttggctatatatttaagtgagaacaaaaaaggtagttgcctaaagtaataaaggacaaagattttaaatagaaaattatcttgggaagtaatggaagaattgcaagagaatcaatgaaattagaagtgacaagcctccaatttttgctgttgataattatgatctgaatgttttaaagtgagcgttatcacactttaaaagtaccagaaggaatgcagtgagccatttatatctactgcttgtacccttcctgactttgaaaagcaagtgctcagtgtttcaaagagttgatctcagtgattgtgttttctgaagattatctatgtgtactctttgattcaagggaatgggatttgagaaagtggggagtgttgggatgacatattttgaaagctatgagttaatatatgcattaaatatattaagtcagttgtattagcatatatgattcagttttcagcgacagctctgtttcctccttcctatggcaacacataacacagtgacaggcaagtatcatgagtatccaggaatta

SEQ ID NO: 12682 - DNA, 11057 bp, Homo sapiens
catggtgtatatgtgccacattttcttaatccagtctatcattgttggacatttgggttggttccaagtctttgctattgtgaataatgccacaataaacgtacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcaggctcttttttggttccatatgaactttaaagtagttttttccaattctgtgaagaaaggcattggtagcttgatggggatggcattgaatctgtaaattaccttgggcagtatggccattttcaagatattgattcttcctacccatgagcatggaatgttcttccatttgtttgtatcctcttttatttccttgagcagcggtttgtagttctccttgaagaggtccttcacctcccttgtaagttggattcctaggtattttattctctttgacgcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtgaaaggctttttctgcatctattgagataatcatgtggtttttgttttggctcttgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctgttgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgggaaagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattaattttttgaagtgattttgtgtctctattgcctctttttttttttttcttgagatggagttttgctcttgttgcccaggctggagtgcagtggtgcaatctcagctcactgcaacctccttttcccaggttcaagagattctgcctcagctcactgcaacctccttttcccaggttcaagcggttctcttgcctcagcctcccaagcagctgggaatacaagtgcccgccaccacacccggctaatttgagcatctttcttttttcttttttttaaagagatggagtctcgctgtcgcccaggctggagtgcagtggtcccatctcagctcacctcaacctctgccttccaggttcaagcaattctcctgcctcagcctcctgagtagctgggactacaggtgcacatcaccacactcagctattttttttttttttttttttgtattttagtagagatggggtttcaccatgttgctgaggctggtctcgaactcctgagctctggtaagctgcctgcctcggcctcccaaagtgctaggattacaggcgtgagccactgcacccggcaatttgagcatctttaattgtccttggctttgctcactttaaatatggaagacgggaaagctaaaaatcatgccaggtcacctgtggaacccaaaatgtccttctttctcttatacttaggacatattttatcttaagtcatatttctcaatgttcttgaaaaaaataaggtgagggtggtttttatttggcatttttaggcatgatgccaaacaccaaagagaaaggcctgaaattgtccacagggactcctgtgagagcctcagtcgctcatcatctctcagcgggagaaaagcggggctttcccgggttattttgaatgtgtgctgcgtgctgaccaaacaggcatggaaggaaagaaaacatgcaggacccttgcaggaaaggcaaggcgaggtggcggctgtctgcccttctgatttcctcttagacctgacatctcattggattccagcagttttcagaagtgccttccaaaagcgcagctcctccttccttcttttaaagtggcagcaacatgtccttgattaaaactgccattacgttttaattaaaagggttctttcattcacaagtcattttgagtcagtcaaaataatctcatgcaggctcccagagaaacggccccgttgcctggaacattctcccttgggtgccttccctgcgtggccctcttttatttcagcagcacagttacaagtttgtgcctgaatgctttacttcaatcacatcctgttgctgagaatggaatatcctgggtagtcacagagctcaggattcactgaaacctaacaccatcctgaggcaagaggaagcctcaggaaacaaatagatgagagagaaattgttttcttatttcattgtgtctacatgttgagactttctgatcgggtacctgtgtgagagggacatgaggcttgtatgaatctgctctgttatctcttttgaaagaacaaaatgtcctgctactacgtccaaagcaatgattaaacctagagcaagaccgtggtggggcagccagccacatttggcagagcatttcgttagcaacagaggaggaaaaaggtaacggtgagcagtaggaaatggctcagagaccagtcaaggggaagcacctaccacccaccacctggccttcttcctgaagaagccccacctccagagtggctcctccacccccacccaggctttgtggcaaagggaagggcccaggccttgcccagcagcttctgtgggggctggcagtggggccagggtctgctgtcctgaagtaattctcagtcttattcccaatttcagctgcttgtttcagctcgtgaagccacctcattagtgtgttgacaacacgtattcttaatgatctttcgtgaaaagatattcagaaaggctaaatgtgaaaaacaattcatacttgttcagctcttgatttccaatgcttgatggaggtgagtatggcagttttcagcagtgtggctgtgaatatcaccagagatcacctgttctgtttggaaggggattttcagtggtgtctcgaccaggcttggtctctgtgtccccgtgggagtcctaactgctacactagccagctggactgacacaaacccaggctctgggccttgtctgctcactgtgtttataccgagctgccgtgcctggccctgcttcactctcaccatcaggcaatgccttagtacctatttgttggccttaatccaaagcattttcatttttcagaaagcacgactctggtataaagtttcttctttctctctgcttcgcaagtctcgtaattcacatgttgaagccttaccgtccagtgtgatagtatttgagggttcagcctttttttttccttatttatttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaagggcatgaactcatcattttttatggctgcatagtattgcatggtgtatatgtgccacattttcttaatccagtctatcactgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaaccggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatagtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatttaagtatttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtaatatagtttgaagtcaggtagtgtgatgcctccagctttgttcttttggcttaggattgccttggcgatgcaggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttgtttgtatcctcttttatttccttgagcagcggtttgtagttcttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattagctgtgggtctgtcatagatagctcttattattttgaaatatgtcccatcaatacctaatttattgagagtttttagcatgaaaggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccgactttggtatcagaatgatgctggcctcataaaatgagttagggaggattccctctttttctattgattggaatagtttcagaaggaatggtaccagttccttcttgtacctctggtagaatttggctgtgaatccatctggtcctggactctttttggttggtaagctattgattattgccacaatttcagctcctgttattggtgtattcagagattcaacttcttcctggtttagtcttgggagagtttatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttattctcgttggtttcaaagaacatcttcatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtagtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtgggatgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatgctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggattcctgaatacagcacactgatgggtcttgactctttatccaatttgccagtctgtgtcttttaattggagcatttagtccatttacatttaaagttaatagtgttatgtgtgaatttgaccctgtcattatgatgttagctggttattttgctcgttagttgatgcagtttcttcctagtcccgatggtctttacattttggcatgattttgcagcggttggtaccagttgttcctttccatgtttagcgcttccttcaggagctcttttagggcaggcctggtgtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgaaggtaacccgacctttctctctgcctgcccttaacattttttccttcatttcaacttcggtgaatctgacaattatgtgtcttggagttgctcttctcgaggagtatctttgtggcgttctctgtatttcctgaatctgaacgttggcctcccttgctagattggggaaattctcctggataatatcctgcagagtgttttccaacttggttccactctccccatcactttcaggtacaccaatcagacgtagatttggtcttttcacatagtcccatatttcttggaggctttgctcatttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaattttttttcaaagttttcaacttctttgcctttggtttgagtgtcctcccgtagctcagagtaatttgatcgtctgaagccttcttctctcagctcgtcaaagtcattctccgtccacctttgttccgttgctggtgaggagctgcgttcctttggaggaggagaggtgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcctgttctcagatctccagctgcgtcctgggagaaccactgctctcttcaaagctgtcagacagggacatttaagtctgcagaggttactgctgtcttttagtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagggagactccgtggggtaggaccctccaagccaggtgcgggatataatctcgtggtgcgccattttttaagcccgtcggaaaagcgcagtattcgggtgggagtgacccgattttccaggtgctgtccgtcacccctttctttgactcagaaagggaactccctgaccccttgcgcttcccaggtgaggcaatgcctcgccctgcttcggctcgcgcacggtgcacgcacccactgacctgcgccgactgtctggcactccctagtgagatgaacctggtacctcagatggaaatgcagaaatcacccgtcttctgcgtcactcaggctgggagctgtagaccggagctgttcctattcggccatcttggctcctccctc

SEQ ID NO: 12683 - DNA, 24452 bp, Homo sapiens
attcttttatccgtaaacttcttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatatgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtctctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaatgagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttataagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaatactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttgaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttaggtgtcaattttggatctttcctgctttctcttgtaggcatttagtgctataaatttccctctacacactgctttgaatgcgtcccagagattctggtatgtggtgtctttgttctcattggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttgatttaaagtctgttttatcagagactaggattgcagcccctgcctttttttgttttccattggcttggtagatcttcctccatccttttattttgagcctatgtgtgtctctgcacgtgagatgggtttcctgaatacagcacactgatgggtcttgactctatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttgaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgcttgggggtgcctcccagttaggctgctcgggggtcaggggtcagggactcacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggccggcgcccctcccccagcctcgttgctgccttgtagtttgatctcagactgctgtgctagcaatcagcgagactccgtgggcgtaggaccctctgagccaggtgtgggatataatctcatggtgcgccgtttcttaagccggtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtaaggtacctcagatggaaatgcagaaatcacccgtcttctgcgtcgctcacgctgggagctgtagaccggagctgttcctattcggccatcttggctcctcctcctggtcttgaactcttgacttcaggtgatctacccccctcggcctcccaaagtgctgggattacaggcgtaagccaccatgcctggctaatttatattttccctctattttgcttggacagattgactaaacatttatcaattttatcagtcttttcaaaaaattagcttttggttttattggttttctctgttgtttttcttttcagcttctttgatttatgcactttatcattctcttccttttgctttttggaggatataatttactctttttctagttgtgctttttgtttgttttttaagagatggtgtctcattttattgcctaggctggagtacaagtgtgatcatagctcactgctgcttcaaacttttaggctcaagggatcttcctgtctcagcctcccaagtagctgggactacaggtatacaccactgtgcctggctaatttttttattttttgtagaattgggtctcactgtcttgcccaggctggtttcaagctcctgggctcaagcagccctcccatcttgatctcccagagtgctgggattataggtgtgagccaccatgcccagcctattccagtttttaaggtgaaagtttaaataattgatttgagatatttctttttttttttgagatagaattttgttcttattgcccaggctggagtgcaatggcacgatctcggctcactgcaacctccatctcctgggttcaagcgattctcctgcctcagcctcccgtgtagctgggattacaggcatgtgccaccatgcctggctaattttgtatttttaggagacacggggtttctccatgttggtcaggatggttgagatatttcttttttaaaaaaataaaagcatgtctcagtttccctttatcagtttccctctaaatattgcattagcagaatcccacagattttgctgttttcatttccattttattaaaatattttctaatttcccttataattttatctttgattcatgtgatttagaaatttttgtttaatatccagatattaggtcaggaagagactttgtctggtttcatctttaaaagttgctaaggtttgttccatagcccagaaggtcttttaatgttctatgtgcactaacagaatgtgtacttggctataattgggcagagtgttgttttttatttttatgttttttgagacaaggtcttactttgtttcccaggctggaatgcagtggcacaaacatggtttgctgcagccttaacctcctgggctcaagcgtaagtagcctaggtagctgggactacaggtgcatgccaccaaacccacctgatttttgtattttttttgtagagacagggttttgccctgttgcccaagctggtctcgaactcttgggctcaagcaattctcccatcttggcctctcaaagtgctgggattacagacatgagccactgcacctggccttattctgcttgttctatttattactcttgatcttagccaaaaggccgagaagcgatgtttgttctatttattattgaaaagagaggcactgaagtctacaagtataattatggatttgtatatgtctcctttcaattttatctgtttttgcttcatgtcttttgatgatctgttattagatgcatatatatttaggattgttatctcttctttgggaattgactcttttatcattatgtagttttcttttctttttttttctttctcttttttttgagatggtctgactctgttgcccaggctggagttcaggggcatgatcttggcaaactgcaacctctgcctcccaggctcaagccatcctcccacctcagcctcctgagcagctgggactacaggcacatgctatcatgcccggctaatttttgtattttttttttttgtagagacagggtttcaccatgttgcccaggctggtcttgaactcctgggctcaagcaatctacacacttcagcctcccagagtgctaggattacaggcgtgagccaccatgcccagccagtatttcttatttatttatctaatttttatataaccaatctagctttcttttgattaatgtttccatggtatgtctccatgtttggagtatgtttccatccttttattttcattctattctattctattctatactgtccctaggtattatattctatatttaaagtagttttctggtagacagcatatagttgggttttgtatttgtatttattgttattattattattattatttgagacagagtttcactcttgctgcccggactagagtgcagtggcgcgatcatggctgactgcaacctctgcctcccgggttcaagtgattctcctgcctcagcctcctgagtagctgggattacaggcatgtgccaccacgctcagctaattttgtatttttttttttttttgagacagtgtctcactctgtcgctcaggctggagtgcagtggcgtgatctcggctcactgcaagctccgccttgcaggttcacgccattctcctgcctcagcctcccgaatagctgggactacaggcgcccgccaccatgcccggctaattttttgcatttttagtagagacagggtttcaccgtgttagccaggatggtctcgatctcctgacctcgtgatccgtccacctcggcctcccaaagtgctgggatttcgggcatgagccaccacgcctggcctagttttgtatttttagtagagatgaggtttctccatgttggtcaggctggtctggaatttccgacttcaggtgatccacccgcctcagcctcccaaagtgctgggattacaggcgtgagccatctcgcccggccctgtattttaattttaatccaatatgataatcattgtcatttaattggtgtgtttataccacttaaatgtaatgtaattattgtattggactcacatctgccatcttattatttgttgtctgtcccctcctttattgtagttttcgtttttgtttttttgtgtctctttttcccatcttctttttaattatgtgaaatatttttagagttttattttaattttcctgttgagtatttggcgctatgtcttcttttatttttttttagtgcttttttttttagtgcttgctctaggaattacagtatacatatcaattatttcacagccttcttagagttaatagtttaccacttcaaataaaatgcaaaaaccttataacatagttcactaactcttgccctctgttatagttatcataagtatatatctacacattgaaatctctaccacataatgttattatttttgctatcaacagttttatatatatatttgcacaggtatgatagattatcaggttggattatttttaaactataaaaccaaactctatactgtctataagaaatccactttataaaaggagaaaaatattcttttatatttacccagatactacttttgtttttccttcagttgcgaagttctgagattctctctggtatcatttcccttcagacttaagcatttcttttagagtttttatatttacccatatacttccttaagttttaaagttctgactctctctcttatgcatttttttagaacagttttgctgctgataaatcctcttagttttctgtcatctgagaatgtgtttatttcaccatcttcctgaagggtattttcactggatttatacaaatatacatataaatatttatacaagtataaatatttatacaagtataagtataaatatttatacaagtatgaatatttatacaagtataaatataaatatacaaataatattaagcaaaaaaatgcaaaaatacaagctatatagaagatgcatacaaatttatttcacttacataagttaaacaagtaaaattaaataatgttttatttagctgaatacacatgtatggtaaaaatgtaaagcaaaatgaagaagtgataaacatacaattcaaaatagtggttattcatatccctagaaggaaggcagaagggacacagggaagaggcttaaagatagtggatggtgggtacatggggaataattaatattacatatattttaaactcacaagacagcattcctatgattatagatagttaatattcatttagagttccccacattttgaccatttatgttgtttctcttcctttcctgcatttccttgcttttatctaggattattttccttattgttaagaaactcatttttaggccaggcgcggcacctcacacctgtaatcccaatactttgggaggccgaggtgggccgatcacttgaggtcaggagttcaagaccagcctgatacatgctgaaaccccatctctaccaaaatatgcaaaattagctgggcatggtggtgcacacctgtggtcgcagctactcgggaggctgaggtgggagaatagcttgaacctggggggtggaagttgcagtgagccaaaattgtgctgctgcactccagcctgggtgacagagcaagactctgtttcaaaaaaaaaaaaactaatttttagtagtttttaagtaaagtctgctgtgataaattagttattatttgtctgaaaatatattttgtctttttgtttttaaggacatttgctctggacatagatttctagataagcagttaatttcttttcctactctgaaggttgcataccattgtattctggcttccatcttttctgctgagaagtcaggtgaaatcttagtattgctcttaatgtatctcttctctatttttgagattcctttacattggtttttataaattttactatgagatgtgtgtagttttctttgtacatattcctgcatttgggttcatagtgcttcttgcaccgtggcttgatatcttttaccagttttggaatattcatggacattatactttcagttgtgtcttttgatccattctcctcttcttctaggtctctaattacatgattgttaatgcttttcactgtttctcacacttttatggcatttttgtatcattttatctccccatggttgtactcattcttttcgtctgacatctttgtttgctaatcctttctttatctattaaaacctgttaacaatttttacaaggtaaaagcttttaaaagctgctgttaaactcacctattgagttcttgattttagttagcgtgctttttagttctgaaatttatatttgtttctttttttcatattatagttgtcttatgaaattctcccacttgcctcatattttcttgaagataatggcaattctttaacatccttatctgataactccaaaatctagattacccatggcagagtaatccagagtatgccctgtgtatgggctgcatatggcctgtagcttgtttttgtaaggtctgtgggcaaagaatgttttttatatattaaagattgtaaaaatgagaatatgcaacagaggtggtacatatcctgtaaaacctaatatatttactgtctggccctttatagaaaaagtttgtcagctcctgacttttaggtctgtttctattgtctcttttttctcttggtcttatttctaaatatgcctggaagtagtattttagcattagtgttcacttactacagtttactaagtctagtaaagattttttaaatgaggtgtaacatccacaaagtgtacagtctggtgagttttcagttatgcatgtactcacctagctgtgatatacataaaaatataaaacatttacagcatcccagaagactcctttgaactccctcaaaacatgtattccctgccaggccaggtgcgacggctcacgcctgtaatcccagcactttgggaggccgaggcaggcagatcacgaggtcaggagattgagatcatcctggctaacacggtgaaacctcgtctctactaagaaatacaaaaattagccaggcgtggtggtgggcacctgtagtcccagttactcaggaggctgaggaaggagattcgcttgaaccccggaggtggagcttgcagtgacccaagatcacaccactgcactccagcctgggcgacacagcgagactccatctcagaataaataaataaataaataaataaataaataaataaataaataaataaatgccctgccaaagacagccacttttctgacttttatcaccttagattcattttgcttgttcttaaactttatgtaaatggaattataccatatttcctgttttatgttcagcttttcccagtgttacatctgtggcattcatccatgttattgcacataacagtagtttatcctttttattactgtgtaatattccattgtataagtatttcagtttattccttctgtagttggtagacatctgggttttatctcttatattttagaactataatctatctgaagttgttatatatcaagtttcatgtctttccacaaggatatcccattgacccagggccacttgtcctttccccgctgcattgtggtgtgtctttgttacaaatcaggtggctggctgggcacagtggctcacacctgtaatcctagcactttgggagaccaaggtgggtggatcacaaggtcaggagttcaagaccagcctggccaatatggtgaaaccctgtctctactaaaaatacaaaaattagccaggcatggtggcatatgcctgtaatcccagctacttgggaggctgaggcaggagaattgcttgaacccgggaggtggaggttgcagtgagccaagatcgcatcactgcactccagcctgagcaacagagcaagattccatctcagaaatcaatcaatcaatcaggtggccatttatgtgagcgtctgttctaggatctccattctgtcccattgttctaccatccaccatgtcaatgctaccctgtcacaatgactgagactttttccttactgtattctcacgtagagcccagtagaataattacagggcttggagtcccatttcttcagggaatataggtggttggaattctgacaccagataaatcaaatatgctggaaaaagaattcctattttaggcaaaagctttattggaagtttgcggcatcctttccgcattgttcattgctgttcagagtgttgctgctgtggtgctataaatgctcccagcagctctcaggttttctttccttccagctagcctccccctaacttcccactccagccaaaaaaagatgcactgtataagtctctgatgagggataaaaatcctttaaagtgtattattaatcttgagctttcagcaaaaaaaaaaaaaaaaaaaaaaattagttttgatttgcttctgattctcaggtttttctttatgttggaatgtaatacttctttcaattttattttatcttatttttttgagacagagtcttggtctgtcacccaggctgaagtgcagtggcgcaatctcatctcatttcaacctctgcctcccgggtttgagcgattctcctgccttagcctcccgactagctgggattacaggcatgtgccaccactcagtgctaattttttgtatgtttagtagagatgaggtttcaccatgttggctaggctggttttgaactcctgacctcaagtgatctgcctccctcagcctcccaaagtgctgggattacgggcatgagccactgtgtccagcccccattttatattttagtatttttttctctctctcttttttaccataagcatctgttaaacttttaaatcttccttaattataatattttaaagaatattctaattaaaacaggctaagtacggtggctcatgcctctaatcccagcactttgggaggctgaggcaggcagatcacttcagcccaggagttcaagaccagcctgggcaacatgacaaacctctgtctccaaaagttacaaaaaaaattagcagggtgtggtggtgcatgcttgtagtcccagctacttcggaagcctgaattgggaggatcgcttgagctcggggaggtcaaggctgactgcagtgagccatgattgggcccctgcactccagcctgggcgacagagtgagaccctgtctcctgctttttttttggagatagggtctcgctctgtttcccaggctggagtgcagtgacatgatctcggctcactgcagccttggctcatgcaacctctgcctcccacgttcaagcgattctcctgcctcagcctcctgagttgctgggttgctgggattacaggcatgcgccaccacagccaactaattttttttttttttttttttaagtagagagccagggtttcaccatgttggtctggctggtctcaaactcctgacctcaagtgatccatctgccttggcctcccaatatgctgggattacaggtgtgagccacctcgcccagccaagagtattttaattaaagcaaaagttaaggatattcttgtgtagaacagggattttttttttttaatgtgatgtgtgcttgtcaattcaggttgaatatgaatgggagaagaaatttttattataattagtttttaaatgactcatcttaaaagaaccatttaagccaaaatagtttttaaaggtttaaatgtatcaattaaaatatttttctttttaggaaaaaagaaaaggagattgaagtttgtggagggccgagggcggaggattgaccctggctccaagttcacaaaggcctcagttctttattaaagtcatgagtcaaaacctgcatctagagctacgtcttagagttagtcacatggacgacagttccctgtatctttttctttttcttttcttttttttttttttgagacagaattttgctctttcacccaggctggagtgaagtggcacagtcttagctcactgcaacctctgccccctgtgttcaagcgattctcctgcctcagcgtctggagtagctgggattataggcacctgccactatgcctggctaatttttgtaattttagtagagatggggttttgccatgttggtcaggctgctctcgaactcctgacctgaggttacccacccgcctcggcctcccaaagtggtaggattataggcgtgagccaccgcgcccggctggcccctgtatctttttccttccaaatacacagctgtgtagaaggacagttatctctggtacaccagagtcattgtagcacattttatttactgagagaaatattttgccccagcattcagttgggtgaaaaatcagggaagatctttataaaacagaaatggcataggttttctgggatagttgtagataagaggtatttattcttcctaaataatagatatatggttatcataaggaaatatgatgaaaaattgttcataacagtaacatttattaaaatgcttcctaggtgccaggagttatgacaagttccttatgtaattatctcactgaacaatcacttgttcaagattttggtctgacctgagacctcatgtacttgttcattgtatttccaaaatacactttcaacttttttattgtgtcactaaaatcctgccatttttccattcattgttgctaataatacttctacatttcaacatttagtttcaacatgtatagctcttaaatcttgtaattagcaataatttgccattggaactagaactagcgacatcgtgaggtcaacatgtttttttttttttttttttttgcaaatcctgcccttcaccaaagggcagtccattctttacatggcaaaaatacatggaaatgttttacgtgttataaacaaacatggcagcagcccagctgttggaagaatcttcatttacagaggccacaatgactcggcactctactgcttcttgagacatgggaaagtggcttttgcctggaagaacacgagtggttgcagttttctaacaaatgcttgataagtaacattctcttgagtaacctaatggtaataagttgaaaagagagaattaggccgggcacgatggctcgcacctgtaatcccagcactttgggaggccgaggtgggcggatcacctgaggtcgggagttcgagaccagcctgaccaacatggagaaaccctgtttctactgaaaatacaaaattagctgggtgcggtggcgcatgcctgtaatcccagctgctcgggaggctgaagcaggagaatctcttgaacccaggaggcggaggttgccatgagccaagatcatgccattgcactccagcctgggcaacaagagcaaaactccgtctcaaaaaaaaaaaaaaaaaaaaggaaacagagaattaaagctgataagctgatatttgtattcatctcatataaaatctttcaagcacacctcatgtcttccttctcctttgaccaccccgttctaatgagcatttcccctcctgcctcataggaactgcctcctgagcgtggagcctgccattagcaccaagcacctcccttaccagagcttccagctcttcggctttgacttcatggtcgatgaggagctgaaggtgtggctcattgaggtcaacggtgcccctgcatgtgctcagtaagcctgcacgtcattgtgtttttacaagtgggaagttggttctgcagttgggatagtctgtgggtacaagtgtagtcactttgactgctgtgagggaggatgccacagtgataggagacccttgggaggactctatctggcagggggctttgctgagtcacttcctttcctatttccccgtgtataggccagataggcccagtgtggtagctcatgcttgtaatcccagcactttgggaggccaagacaggtagactgtcaggtagactgtctgagcccaggagttcaagaccagcctgggcagcctggcaaaaccccatctctacaaaaaatacagaaattagtcaggcatggtgctgtgtgcctatagtcccagctgctcgggaggctgaggtgggaggatcacttgagcctgggaggttgaggctgcagtgagccatgactgcaccactgcattgcagcctgggcgacagagagaccctgtctcaaaagtaaaaaatgtaagcagctagcctgtgctcaggtgggtgggagatgccatgagagtgttaaagttcattactgccagagagacccgtatgacaagctgagtaagcaggatcctatgatgtggcgacccagaagttcagagcctcctgaggcaggaaggagtcagagaaggcatcttagacatggggggtctggagctggggtgcaagaaaagagggttccgctgcaccaaaggttggtggggagagtcttccaaaagaggtgcagcgtcctgtgggctctcaccctgtcccgggctctgcaggtctgggagatgcccagaggaacagaagctcctgagaacctgctctccggaacttctgcttctctcgggagaaggctggttgtagcatgagcgtcatggagtcattaaggaggaaggaaggtaagagaggaccttctgtggaaggccttacgtgtcagggaaagtcactcggactcaattctcttgtgctgagggttcttctgaagatcctctttcatgatgtcaagaccctttcgtggttcccatctacatcttgaagaaattgagtgatttttcaaaatgtttaagagaaagtcccgtacctgcaagggacgatgtcaacacaccaaagttgttctttacttagaagctaggcctttgccattgcctgatggttacgacaggcatgattgcatgattccatcttgttcatcagtctctgcagccgataagtgcttatcaggtgctgcctacctggccaggctctgtatgaggccatgggttcacagtggggagcaaagagagacacaggccctacctttcgtggggagagactgtgagcagacagataccaggcagatgtcaattacaagcgaggacaagtgcttcaatggagaacaaaggatgttgaaaggtaacgtaactgagccaagggcccacgatgggaagtgatgttggaactgagatctgaaggccaaacgcaagttagatgggctaagggcggaataaggcagggatccgcaccttccctcaccaaatcaacagtggtgtgcccagtctcacccactgtcctttcctatcaggggtttgtccctccatggtgctctagacctttccctcctcccgctcctgtcttctcatctggcagttaacattgtcacctttttccctctctgatgcataattcttgtcagcatatgcagtcccagcagattttcccaactattcaaaaagatgtcctcccctgatgccacatcctgttccaatgatcacgccttctccagttcccttcacagccaagcttctggagagcagcttctgcacaagctgtcttctattcctctgttcccatccatgttccagtccattccaggctggctcccatcctgattgcctcacagaaactgttctttgcaggtccccagccaagtccttattgccacctccagcagcctctttctgtccccacccccttggacctgtcagcagcattcgaggcaaccgacagcacttgctgagctgctctcctgtcatggctggacacgtggtgctgggcaggcttgcctggtgaggtgtgggcaagctggactccgtcttcttcatccagtgcctctggtcttaggcctgggtgtttgtctcctctctgtgtatgtgatctcatccaacttcatgattttgaaattaccaaattacatcacagcccagagatgcagactagtatctgcacctgccttccctgccagaatgtctcccgtctgcctccagacttacccatcttggtcggtcaccaccccctgctccccccagagactaagctcgaacctgacagtgatcctgcctctgccttcccttcccctcaagtcctgcccatcagggccctgtgggttgtacctctagcctccggagtcctttgccctccatttgcactgtcacccctgcacagggtgtcttccaccatagtgaaggttttggcatggagccttctaactggggtgcacttctgctcttgccccagtgaaatccatcctcccagagcagccagtgtgtaaagtcgacaccagaccatgccattctccagacttgccattgcacctaggacacaaaccagactcctccctccacctccaaggccgctgccttacccacctctccagcttcatcccaagtcaccatttcccttgattgctcttatctgcagtgggcctttgtgctttctgttacctgtgtgtggaatccccaccaccattaccaccaccaccaccagccttaccgtggctggcttcttctttaccaaaacatcttgaggaagctttctctgaacagtcctagctctgattttctctaggcagagcctttgcagtttccttcattgcactaactgccatcagattaactcatcagaagaaactgtctgtgggtgtgtgtgtgtctgtgtgtgtgtgtgtgtgtgtgtatccgccccttcttctttatttctaccctgtcatccattctctgtctgccttctattcattgggtcttggcttagctgccactggaaagtcttcccctgtcactggggagtcttcctctgtcactggggagtcttcctctgtcactggggagtcttcccgtgtcactggggagtcttctccagtgtcccttcaattatgctgagttggtccttttcctgggtagggcctgcccctgtctgtaatgcaaggtggctcttacatgctcttgaaatgcctgccttccctgccagttgtgtgccttgttcacctgcaaggccttccataagtatttgctgagggaatgctttatcttcgtgcaaaggcttctgaagcatctgtatatacagtggcaaccagtttttttttttctttatttttttgacattttgttattattatactttaagttctagggtacatgtgcacaatgtgtaggtttgttacatatgtatacatgtgccatgttggtgtgctgtacccattaactcatcatttacattaggtataactcctaatgttatccttcccccatcccccaaccccacaacaggccctggtgtgtgatgttccccatcctacgtccaagtggtctcattgttcagttcccacctatgagtgagaacatgcagtgttttgttttctatccctgtgatagtttgctcagaatgatggtttccagcttcatccatgtccctacaaaggacatgaactcgtcctttcttatggctgcatagtattccatggtatatatgtgccacattttcttaatccagtctatcattgatggacatttgggttggttccaagtctttgctattgtgaatagtgctacaataaacatacatgtgcatgtgtctttatagcagcatgatttataatcctttgggtatatacccagtaatgggatggctgggtcaaatggtatttctagttctagatcgttgaggaatcgccacactgtcttctgcaatggttgaactagtttacagccccaccaacagtgtaaaagtgttcctatttctccacatcctctccagcacctgttgcttcctgactttttaatgatcaccattctaactggtgtgagatggtatctcattgtggttttgatttgcatttctctgatggccagtgatgagcattttttcatgtgtcttttggctgcataaatgtcttcttttgagaagcgtctgttcatatcctttgcccactttttgatggggttgtttgattttttcttgtaaatttgtttaagttctttgtagattctggatatcagccctttgtcagatgggtagattgtaaaaattttctcccattctgtaggttgcctgtttgctgatggtagtttcttttgctgtgcagaagctctttagtttaattagatcccatttgtcaatttttgcttttgttgccattgcttttggtgttttagacatgaagtcctttcccatgcctatgtcctgaatggtattgcctaggttttcttctagggtttttatggttttacatctaacatttaagtcattaatgcgtcctgaattaatttttgtataaggtgtaaggaagggatccagtttcagctttctatgtatggctagccagttttcccagcaccatttattaaatagggaatcctttcctcatttcttgtttttatcaggtttgtcaaacatcaggtggttgtagatgtgtgacattatttctgagggctctgttctgttccattggtctatatctctgttttggtaccagtaccatgctgttttggttactgtagccttgtagtatagtttgaagtcaggtagggtgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttgggtagtatggccattttcacaacattgattcttcctatccatgagcatggaatggtcttccatttgtttgtgtcctcttttatttcgttgagcagcggtttgtagttctccttgaagaggtcctttacatcccttgtaagttggattattggtattttattctctctgaagcagttgtgaatgggagttcactcatgatttggctgtttgtctgttattggtttataggaatgcttgtgatttttgcacatcaattttgtatcctgagactttgctgaagttgcttatcagcttaaggagattttgggctgagatgatggggttttctaaatatacaatcatgtcatcggcaaacagggacaatttgacttccttttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctagtttattgagagtttttagcatgaaggttgttgaattttgtcaaaggccttttctgcatctattgagataatcatgtggtttttgtctttggttctgtttatatgatggattacgtttattgatttgcatatgttgaaccagccttgcatcccagggatgaagcccacttgatcatggtggataagctttttgatgtgctgctggatttagtttgccagtattttgttgaggatttttgcatcgatgttcatcagggatattggtctaaaattgtcttttttttgttgtgtctctgccaggctttggtgtcaggatgatgctggcctcataaaatgagttagggaggagtccctctttttctgttgattggaatagtttcagaaggaatggtaccagctcctctttgtacctctggtagaatttggctgtgaatccatctggtcctggactttttttggttggtaggctattaattattgcctcaatttcagagccagttattggtctattcagggattcaacttcttccttgtttagtcttgggagggtgtatgtgtccaggaatttatccatttcttctagattttctagtttatttgtgtagaggtgtttatagtattttctgatggtagtttgtctttctgtgggatcagtggtgataacccctttatcattttttattgcgtctatttgattcttctctcttttcttctttattagtcttgctagcggtctatcagttttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgaagttagggtatcaattttagatctttcctgctttctcttgtgggcatttagtgctataaatttctgtctacccactgctttaaatgtgtcccagagattctggtatgttgtggctttgttctcattggtttcaaagaacatctttatttctgccttcacttcgttatgtacccagtagttattcaggagcaggttgttctgtttccatgtagttgagcggttttgagtgagtttcttaatcctgatttctagtttgattgcactgtggtctgggagacagtttgttataatttctgttcttttacatttgctgaggagtgctttacttccaattatgtggtcgctttacttccaattatgtggtcaattttggaataagtgagatatgtggtgctgagaaggatgtagattctgttgatttggggtggagagttctgtagatgtctattaggtctgcttggtgcagagctgagttcaattcctggatatccttgttaacttttagtctcattgatctgtctaatgttgacagtgggatgttgaagtctcccactattattgtgtaggagtctaagtctctttgtaagtctctaaggacttgctttatgaatctgggtgcgcctgtattgggtgcatatatatttaggatagttagctcttttgttgaattgatccctttatcattatgtaatggccttctttgtctcttttgatctttgttgatttaaagtctgttttatcagagactaggattgcaacccctgctttttttgttttccatttgcttggtagatcttcttccatcccttttattttgagcctatgtgtgtctctgcacgtgaggtgggtctcctgaatagagcacactgatgggtcttgactgtttatccaatttgccagtctgtgtcttttaattggagcatttagcccatttacacttaaggttaatattgttatatgtgaatttgatcctgtcattatgatgttagctggttattttgcccgttagttgatgcagtttcttcctagcatctatggtctttacagtttggcatgtttttgcagtggctggtaccagttgttcctttccatgtttagtgcttccttcaggagctcttgtaaggcaggcctggtggtgacaaaatttcttagcatttgcttgtctgtagaggattttatttctcctttacttttgaagcttagtttggctggatatgaaattctgggttgaaaattcttttctttaagaatgttgaatattggcccccactctcttctggcttgtagagtttctgccgagagatccgctattagtctgataggcttccctttgtgggtaacccgacctttctctctggctg

SEQ ID NO: 12684 - DNA, 5846 bp, Homo sapiens
ttttctatcccattctcactctctttttttttttttttttttattatactttaagttttagggtacatgtgcacattgtgcaggttagttacatatgtatacatgtgccatgctggtgcgctgcacccactaacgtgtcaactagcattaagtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcgtcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctcttattggtctattcagagattcaacttcttcctgttttagtcttgggagagtgtatgtgtcgaggaatgtatccatttcttctagattttctagtttatttgcgtagaggtgtttgtagtattctcttatggtagtttgcatttctgtgcgatcagtggtgatatcccctttatcattttttattgtgtctatttgattcttctctctttttttctttattagtcttgctagcggtctatcaattttgttgatcctttcaaaaaaccagctcctggattctttgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttagcattatgtaatggccttctttgtctcttttgatctttgttggtttaaagtctgttttatcagagactagaattgcaacccctgcctttttttgttttccattggcttggtggatcttcctccatccttttattttgagcctatgtgtgtctctgcacgtgagatgggtttcctgaatacagcacactgatgggtcttgactgtttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcgtttgagggtaacccgacctttccctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcatacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttgcttttcagctccatcagctcctttaagcacttctctgtattggttattctagttatacattcttctaaattttttcaaagttttcaacttctttgcctttggtttgaatgtcttcccgtagctcagagtaatttgatcgtctgaagccttcttctctcagctcgtcaaaatcattctccatccagctttgttccgttgctggtgaggaactgtgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctgtttgtttgtctgtgccctgcccccagaggtggagcctacagaggcaggcaggcctccttgagttgtggtgggctccacccagttcgagcttccaggctgctttgtttacctaagcaagcctgggcaatggcgggcgcccctcccccagcctcattgccgccttgcagtttgatctcagactgctgtgttagcaatcagcgagattccgtgggcgtaggaccctctgagccaggtgtgggatatagtctcgtggtgcgccgtttcttaagccggtctgaaaagcgcaatattcaggtgggagtgacccgattttccaggtgcgtccgtcacccctttctttgactcggaaagggaactccctgacccc

SEQ ID NO: 12685 - DNA, 4916 bp, Homo sapiens
ttaaaatttttttatttttattatactttaagttctagggtacatgtgcacaacatgcaggtttgttacatatgtatacatgtgccatgttggtgtgctgcacccattaactcatcatttacattaggtttatctcctaatgctaaccctccccccttcccccaccccatgacaggccccggtgtgtggtgtacccccttctgtgtccaagtgttctcattgttcaattcccacctatgagtgagaacatgcggtgtttggttttttgtccttgtgatagtttgcggagaatgatggtttccagcttcatccatgtccctacaaaggacatgaactcatccttttttatggctgcatagtattcgatggtatatatgtgccacattttcttaatccagtctatcattgatggacatttgggttggttccaagtctttgctattgtgaatagtgccgcaataagcatacgtgtgaatgtgtctttatagcagcatgatttataatcctttgggtatatacccagtaatgggatggctgggtcaaatggtatttctaggtctagactcttgaggagtcgccacactgtcttccacaatggttgaactagtttacagtcccaccaacagtgtaaaagtgttcctatttctccacatcctctccagcacctgttgtttcttgactttttaatgatcgccattctaactggtgtgagatggtatctcattgtggttttgatttgcatttctctgatggccagtgatgatgagcattttttcatgtgtctgttgggtgcataaatgtcttcttttgagaagtgtctgttcatgtcctttgcccactttttgatggggttgtttgtttttttcttgtaagtttgtttgagttctttgtagattctgaatattagccctttgtcagatgagtagattgcaaaaattttctcccattctgtaggttacctgttcactctgatggtagtttcttttgctgtgcagaagctctttagtttaattagatcccatttgtcaattttggcttctgttgccattgcttttggtgttttagatgtgaagtccttgcccatgcctatgtcctgaatggtattgcctaggttttcttctagggtttttatggttttaggtctaacatttaagtctttcatccatcttgaattaatttttgtataaggtgtaaggaagggatccagtttcagctttctccgtatggctagccagttttcccagcaccatttattaaatagggaatcctttccccatttcttgtttttgtcaggtttgtcaaagatcagatggttgatgtatggtattatttctgagggctctgttcttttccattggtctatatctctgttttggtaccagtaccatgctgttttggttactacagccttgtagtatagtttgaagtcaggtagtgtgatgcctccagctttgttctttgggcttaggattgtcttggcaatgcgggcccttttttggttccatatgaactttaaagtagtttttttccaattctgtgaagaaagtcattggtagcttgatggggatggcattgaatctataaattaccttgggcagtatggccattttcacaatgttgattcttcctacccgtgagcatggaacgttcttccatttgtttgtgtcctcttttatttcattgagcagtggtttgtagttctctttgaagaggtccttcacatacctaagttggattcctaggtattctgttatctttgcagcaattgtgagttcactcatgatttggctctctgtttgtctgttattggtgtataagaatggttgtgatttttgcacattgattttgtattctgagactttgctgaagttgcttatcagcttaaggagattttagactgagacgatggggttttctaaatatacaatcatgtcatctgcaaacagggacaatttgacttcctcttttcctaattgaataccctttatttctttttcctgcctgattgcgcttgccagaacttccaacactatgttgaataggagtggtgagagaaggcatccctgtcttgtgctggttttcaaagggaatgcttccagtttttgccccttcagcatgatattggctgtgggtttgtcaaaaatagctcttattattttgcaatacatcccatcaatacctaatttattgaaaatttttagcatgaagggctgttgacgtttgtcaaaggccttttctgcatctattgagataatcatgtggcttttgtctttggttctttttatatgctggattacgtttattgatttgcatacattgaaccagccttgcatcccagggatgaagcccacttgatcatggtggataagctttttgatgtgctgctggattctgtttgccagtattttattgaagatttttgcatcaatattcatcagggatattggcctaaaattctctttttttgttgtgtctgccaggctttggtatcaggatgatgctggtctcataaaatgaattagggaggattccctcttttctattgattggaatagtttcagaaggaatggtaccagctcctccttgtacatctggtagaattcagctgtgagtctctctggtcctggactttttttggttggtaggctattaattattgcctcaatttgagagcctgttattggtctgttcagggattcaacttcatcctggtttagtcttgggatggtgtatgtgtccaggaatgtatccatttcttctagattttctagtttatttgcgtagaggtgtttatagtattctctgatggtagtttgtatttctgtgggatcagtggtgatatcccctttctcatgttttatggcatctatatgattcttctctcttttcttctttattagtcttgctagtggtctattaattttttgatcttttcaaaaaaaccagctcctggattcattgattttttttgaagggttttttgtgtctctatctccttcagttctgctctgctcttagttatttcttgtcttctgctagcttttgaatgtgtttgctcttggttctctagttcttttaattgtgatgttagggtgtcaattttagatctttcctgctttctcttgtgggcatttagtgctataaatttccctctacagagtgctttaaatgtgtcccagacattctggtatgttgtgtctttgttctcattggtttcaaagaacatctttagttctgccttcatttcgttatgtacccagtagtcattcaggagcaggttgttcagtttccacatagatgagtggatttgagtgagtttcttaatcctgagttctagtttgattgcactgtggtctgagagacagtttgttataatttctattcttttacatttgctgaggagtgctttacttccaacgatgtggtcaattttggaataagtgtgatgtggtgctgagaagaatgtatattctgttaatttgggatggagagttctgtagatgtctattaggtccactgggtgcagagctgagttcaattcctggatatccttgttaactttctgtcttgttgatctgtctaatgttgacattgtggtgttaaagtctcccattattattgtatgggagtctaagtctctttgtaggtctccaaggacttgctttatgaagctaggtgctcctgtattgggtgcatatatgtgtaggatagttagctcttcttgttgaattgatccctttaccattatgtaatggccttctttgtctcttttgatccttgttggtttaaagtctgttttatcagagactaggattgcaatccctgccttttttgttttccatttgcttggtagatcttcctccatccttttattttgagcctatgtgagtctctgcacgtgagatgggtctcctgaatacagcacactgatgggtctcgactctttatcccatttgacagtctgtatcttttaattggagtatttagcccatttacatttaaggttaatattgttatgtgtgaatttgatcctgtcactttgatgttagctggttattttgctctttagttgatgcagtttcttcctagcctcgatgttctttacaatttggcatgtttttgcagtggctggtaccggttgttcctttccatgtttagtgcttccttcaggagctcttgtagggcaggcctggtggtgacaaaatctctcagcatttgcttgtctataaaggattttatttctccttcacttatgaagcttagttggatatgaaattctgggttgaaaattcttttctttaagaatgttgaatatttgcccctactctcttctggcttgtagagtttctgccaagagatccgctgttagtctgatgggcttccctttgtgggtaacccgacctttctctctggctgcccttaacgttttttccttcatttcaactttggtgaatctgacaattatgtgtcttggagttgctcttctcgaggaatatctttgtggcattctctgtatctcctgaatttgaatgttggcctgccttgctaggttggggaagttctcctggataattcctgcagagtgttttccaacttggttccattctctctgtcactttcaggtacaccaatcagatgtagatctcatctggtcttttcacatagtcccatatttcttggaggctttgttcatttctttttactcttttttctctaaacttctcttctcgcttcatttcgttcatttgattttcaatcactgataccctttcttccagttgattgaattcgctactgaagcttgtgcgttcatcacgtagttcttttgccatgttttttagctccatcaggtcatttaaggacttctctacattggttattctagttatccattcgtctaatcttttttcaaggtt

SEQ ID NO: 12686 - DNA, 5916 bp, Homo sapiens
cattaggtatttctcctaatgctatccctcccctagccccccaccccccgacaggcctggtgtgtgatgttcccctccttgtgtccaggtgttctcattgttcaactcccacttataagtgagaacatgtcatgtttggttttctgttcttgtgatagtttactgagaatggtggtttctggcttcatccatgtccctgcaaaggacatgaactcatccttttttatgactgcatagtattccatggtgtatatgtgccacattttctttatccagtctatcattgatggacatttgggttggttccaaatctgctattgtgagcatgccacaataaacatacgtgtggatgtgtctttatagcagcatgatttataatcctttgggtatatacccagtaatgggattactgagtcagatggtatttctagttctagatccctgaggaatcaccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattacgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtcattggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaaggtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggatattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgaccgtcacccctttctttgactcagaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccccg

SEQ ID NO: 12687 - DNA, 6029 bp, Homo sapiens
cttttttttttttttattatactttaagttttagggtacatgtgcacattgtgcaggttagttacatatgtatacatttgccatgctggtgcactgcacccactaactcgtcatctagcattacgtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggatccaagtctttgctattgtgaataatgccacagtaaacatacgtgtgcatgtgtgtttatagcagcatgatttatggtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctacctggtgtgagatggtatctcattgtggttttgatttgcatttgtctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgcagattctggatattagccctttgtcagatgagtaggttgcgaaaattttctcccattttgtaggttgcccgttcactctgatggtagtttcttttgctgtgcagaagctctttagtttaattagatcccatatgtcaattttgtcttttgttgccattgcttttggtgttttggacatgaagtccttgcccatgcctatgtcctgaatggtactgcctaggttttcttctagggtttttatggttttgggtctaatgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccgtgctgttttggttactgtagccttgtagtatagtttgaagtcaggtagtgtgatgcctccagctttgttcttttggcttaggatcgccttggcgatgcgggctcttttttggttccatatgaactttaaagtagttttttccaattctgtgaagaaagtcattggtagctttatggggatggcactgaatctgtaaattaccttgggcagtatggccattttcacgatactgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttggtctgagacaatggggttttctagatatacaatcatgtcgtctgcaaacagggacaatttgacttcctcttttcctgattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattagtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcggctgtgaatccatctggtcctggactctttttggttggcaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggcgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtcttgttgatctgtctaatgttgacagtggggtgatcaattctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccctttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtttgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttttagggcaggcctggtggtgacaaaatgtctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccctatcactttcaggtacaccaatcagacgtagatttggtcttttcacatagtcccatatttcttggaggctttgctcatttctttttattcctttttctctaaacttcccttctcgcttcatttcattcatttcatcttccatcactgataccctttcttccagttgatcgcatcggctcctgaggcttctgcattcttcacgtagttctcgagccttggttttcagctccatcagctcgtaagcacttctctgtattggttattctagttatacattcttctaaatttttttcaaagttttcaacttctttgcctttggtttgaatgtcctcccgtagctcagagtaatttgatcgtctgaagacttcttctctcagctcgtcaaagtcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccggaggtggagcctacagaggcaggcaggcctccttgagctgtggtgggctccacccagttcgagcttcccggctgctttgtttacctaagcaagcctgggcaatggcgggcacccctcccccagcctcgctgccgccttgcagtttgatctcagactgctgtgctagcaatcagtgagaccccgtgggcataggaccctccgagccaggtgcgggatataatctcgtgatgtgccgttttttaagccggtccgaaaagcgcaatattcgggtggagtgacctgatttttcaggtgcatccgtcgcccgtttctttgactcggaaagggaactccctgaccccttgcgcttcccaagtgaggcaatgcctcaccctgcttcggctggtgcatggtgcgcgcacccactgacctgcgcccactgtctggcgctccctagtgagatgaacccggtacctcagatggaaatgcagaaatcacccatcttctgcgtcgctcacgctgggagctgtagaccggagctgttcctattcggccatcttggctcctccc

SEQ ID NO: 12688 - DNA, 5671 bp, Homo sapiens
attttacatttttttttttattattatactttaagttctagggtacatgtgcacagcgtgcaggtttgttacatatgtatacatgtgccatgttggtgtgctgcacccattaactcgtcatttacattaggtatatctcctaatgctatccctccccccctccccccaccccaaaacaggccccagtgtgtgatgttccccttcctgtgtccaagtgttctcattgttcaattcccacctatgagtgagaacatgcgacgtttggttttttgtccttgcgatggtttgctgagaatgatggtttccggcttcatccatgtccctagaaaggacatgaactcatcattgtttatggctgcatagtattccatggtgtgtatgtgccacattttcttaatccagtctatcattgttggacatttgggttggttccaggtctttgctattgtgaatagtgccgcaataaacatacgtgtgcatgtgtctttatagcagcatgatttataatcctttgagtatatacccagtaatgggatggctgggtcaaatggtatttctggttctagatccctgaggaatcgccacactgtcttccacaatggttgaaccagtttacagtcccaccaacagtgtaaaagttcctatttctctgcatcctctctagtacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatccttcacccacttgttgatggggttgttttttttcttgtgaaattgtttgagttctttgtagattctggatattagccctttgtcagatgagtagattgcagaaattttctcccattctgtaggttgcctgttcactctgatggtagtttcttttgctgtgcagaagctctttagtttaattagatcccatttgtcaattttggcttttgttgccattgcttttggtggtttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttgttaaatagggaatcctttccccatttctcgtttttgtcaggtttgtcaaaggtcagatggttgtagatgtgtggtattatttctgagggctctgttctgttccattggtctatatctctgttttggcaccagtaccatgctgttttggttactgtagcctggtagtatagtttgaagtcaggtagcgtgatgcttccagctttgttcttttggcttaggattgacttggcaatgcaggctcttttttggttccatatgaactttaaagtagtttttcccaattctgtgaagaaagtcattggtagcttgatggggatggcattgaatctataaattaccttgggcagtatggccgttttcacgatattgattcttcctacccatgagcatggaatgttcttccatttgtttgtatcctcttttatttcattgagcagtggtttgtagttctccttggagaggtccttcacctcccttgtaagttggattcctaggtattttattctctttgaagcaattgtgaatgggatttcactcatgatttggctctctgtttgtctgttattggtgtataagaatgcttgtgatttttgcacattgatttttgtatcctgagactttgctgaagttgcttatcaccttgagattctgggctgagacgatggggttttctagatatacaatcatgttatctgcaaacagggacaatttgacttcttcttttcctaactgaataccctttatttctttctcctgcctaattgccctggccagaacttccaacactgtgttgaataggagtggtgagagagggagggcatccctgtcttgtgccagttttcaaagggaatgcttccagtttttgcccattcagtatgatattggctgtgggtttgtcataaatagctcttattgttttgagatacatcccatcaatacctaatttattgagagtttttagcatgaagggctattgaattttgtcaaaggccttttctgcatctattgaaatgatcatttagtttttgtcattggttctgtttatatgctggattacatttattgatttgtgtatgttgaaccagccttgcatcccagggatgaagcccacttgatcaaggtggataagctttttgatgtgctgctggattcagtttgccagtattttattgaggatttttgcatcaatgttcatcagggatattggtctaaaattctctttttttgttgtgtctctgctaggctttggtatcaggatgatgttggcctcataaaatgagttagggaggattccctctttttctattgattggaatagtttcagaaggaatggtaccagctcctccttgtacctctggtagaattcggctgtgaatccgtctggtcctggactttttttggttggtaagctattaattattgcctcaatttcagagcctgttattggtctattcagagattcaacttcttcctggtttagtcttgggagagtgtatatgtcaaggaatttatccatttcttctagattttctagtttatttgcgtaggggtgttcatagtattctctgatggtagtttgtatttctgtgggatctgtggtgatatcccctttatcaatttttattgtgtatatttgattcttctctcttttcttctttcttactcttgctagcggtctatcaattttgttgatcttttcaaaaaaccagctcctggattcattgatttttttgaagggttttttctgtctctatcttcttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatattgtgcctttattctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggccaattttggagtaagtgcagtgtggtgctgagaagaatgtatattctgttgatttggggtggagagttctgtagatgtctattaggtccacttggtgcagagctgagttcaatttctggatatccttgttaaccttctgtctcattgatctgtctaatgttgacagtcgggtgttaaagtctcccattattattgtgtgggagtctaagtctctttgtaggtctctaaggacctgctttatgaatctgggtgctcctatattgggtgcatgtatatttaagatagttagctcttcttgttgaattgatccctttaccattatgtaatggccttctttgtctcttttgatctttgttggtttaaagtctgttttatcagagactaggattgcaacccctgcctctttttgttttccatttgcttggtagatcttcctccatccctttattttgagcctatgtgtgtctctgcacatgagatgggtttcctgaatatagcacactgacgggtcttgactcttcatccagtttgccagtctgtgtcttttaattggagcattcagcccatttacatttaaggttaatattgttatgtgtgaatttgatcctgtcattatgatgttagctggttattttgctcgttagttgatgcagtttcttcctagcatcgatggtctttacaatttggcatgtttttgcagtggctggtaccagttgttcctttctatgtttaatgcttccttcaggagttcttgtagggcaggcctggtggtgacagaatctctcagcatttgcttgtctgtaaagtattttatttctccttcacttatgaagcttagtttggctggatatgaaattctgggttgaacattcttttctttaagaatgctgaatattggcccccactctcttctggcttgtagagtttctgccaagagatcagctgttagtctgatgggcttccctttgtgggtaacccgacctttctctctggctgcccttaacatttttgccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccaacttggttccattctccctgtcactttcaggtacaccaatcagacgtagatttggtcttttcacatagtcccatatttcttggaggctttgttcatttctttttattcttttttctctaaacttctcttctcacttcatttcattcatttgatcttccatcactgataccctttcttctagttgatcgaatcagctactgaagcttgtgcattcgtcacgtagttcttgtgccatggttttcagctccatcaggtcctttaaggacttatctgcattggtgattctagttagccattcgtctaatcttttttcaaggtttttaacttctttgtgttgggtttgaacttcctcctttagctcggagaaattcgatcatctgtagccttcttctctcaacttgtcaaagtcattctccatccagctttgttccattgctggtgaggagctgcattcctttggaggaggagagatgctctgatttttagaattttcagtttttctgctctgttttttcccctctttgtggttttatctacctttggttttgatgatggtgatgtacagatggggttttggtgtggatgtcctctctgtttgttagttttccttctaacagtcaggaccctcagctgcaggtctgttagagttttctggaggtccactccagaccctttttgcctgggtatcagcagtggaggctgcagaacagcaaatattggtgaacagcaaatgttgctgcctgatcgttcctctggaagtttcatctcagagggatacccggccgtgtgaggtgtcaatctgcccctactggggggtgcctcccagttaggctacttgggggtcagggaaccacttgaggaggcagtctgtccgttctcagatctcaagctccgtgctgggagaaccactgctgtcttccaagctgtcagacagggacatttaagtctgcagaggtttctgctgccttttgtttggctatgccctgcccccagaggtggagtctacagaggcaggcaggcctccttgagctgcggtgagctccacccagttcgagctt

SEQ ID NO: 12689 - DNA, 845 bp, Homo sapiens; identical to SEQ ID NO: 7385

SEQ ID NO: 12690 - DNA, 4121 bp, Homo sapiens
ttatttatttatttatttatttatttatttatttatttattttattttttatttttattatactttaagttttagggtacatgtgcacaacgtgcaggtttgttacatatgtatgcatgtgccatgttggtgtgctgcacccattaacttgtcgtttagcattaggtatatctcctaatgctatccctccccccacccccaccccacaacagtccctggtatgtgatgttccccttcctgtgtccatgtgttctcattgttcaattcccacctatgagtgagaatatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttataatcctttgggtacatacccagtaatgggatggctgggtcaaatggtatttctagttctagatccctgaggaatcgccacactgacttccacaatggttgaactagtttatagtcccaccaacagtgtaaaagcattcctatttctccacatcctctccagcacctgttgtttcctgactttttaatgatcgccattctaacttgtgtgaggtggtatctcattgtggttttgatatgcatttctctgatggccagtgatgatgagcattttttcatgtgttttttggctgcataaatgtcttcttttgaaaagcgtctgttcatatccttcgcccactttttgatgaggttgtttgttttttttcttataaatttgtttgagttcattgtagatgctggatattagccctttgtcagatgagtaggttgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaatttatttttgtataaggtgtaaggaagggatccagtttcaactttctacatatggctagccagttttcccagcaccatttattaaatagggaatcctttccccattgcttgtttttgtcaggtttgtcaaagatcagataatattagatatgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgtgggctcttttttggttccatatgaactttaaagtagtattttccaattctgtgaagaaagtcattggtagcttgatggggatggcattgaatctataaattaccttgggcagtatggccattttcacaatattgatttttcctacccatgagcatggaatgttcttccatttgtttgtatcctcttttatttcattgagcagtggtttgtagttctccttgaagaggtcctttacatcccttgtaagttggattcctaggtattttattctctttgaagcaattgtgaatgggagttcactcatgatttggctctctgtttttctgttattggtgtataagaatgcttctgatttttgtacattgattttgtatcctgagactttgctgaagttgcttatcagtttaaggagattttgggctgagactatggggttttctaggtatacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagagagtgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcaggtggtttttgtctttggttctgtttatatgctggattacgtttattgattttcatatgttgaaccagccttgcatcccagggatgaagcccacttgatcacggtggataaactttttgatgtgttgctggattcggtttgccagtattttattgaagatttttgcatcaatgttcatcaaggatattggtctaaaattctcttttttttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactttttttggtgggtaagctattaattattgcctcaatttcagagcctgttattggtctattcagagattcaatttcttcctggtttagtcttgggagagtgtatgtgttgaggaatttatccatttcttctagattttctagtttatttgcatagaggtgtttatagtattctctgatggtagtttgtatttcctttgggatcggtggtgatatcccctttatcattttttattgagtctctttgattcttctctcttttcttctttattagtcttgctagcggtctgtcgattttgttgatcttttcaaaaaaccagctcctggattcgttgattttttgaagggttttttgtgtctctatctccttcagttctgctctgatcttagttattcttgccttctgctagcttttgaatgtgtttgttcttgcttctctagttcttttaattgtgatgttagggtgtcaattttagatctttcctgctttctcttgtgggcatttagtgctataaatttccctctacaccctgctttgaatgtgtcccagagattctggtatgttgtgtctttgttctcattggtttcaaagaacatctgtatttcagccttcatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtctgcttggtgcagagctgatttcaattcctggatagccttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttctccttgttgaattgatccctttactattatgtaatggccttctttgtctcttttgatctttgttggtttaaagtctgttttatcagaaactaggattgcaacccctgcctttttttgttttccatttgcttggtatatcttcctgcatccctttattttgagcctatttgtgtctttgcacgtgagatgggtttcctgaatatagcacactgatgggtcttgactctttatccagtttgccagtctgtgccttttaattggagcatttagcccatttacatttaaggttagtattgttatgtgtgaatttgatcctgtcattatgatgttagctggtcattttgctcattag

SEQ ID NO: 12691 - DNA, 6165 bp, Homo sapiens
tattataatctttcttttttttttttttttaatttttttttttattatactttaagttttagggtacatgtgcacattgtgcaggttagttacatatgtatacatgtgccatgctggtgcgctgcacccaccaacgtgtcatctagcattaggtatatctcccaatgctatccctcccccctcccctgaccccaccaccgtccccagagtgtgatattccccttcctgtgtccttgtgatctcattgttcaattcccacctatgagtgagaatatgcggtgtttggttttttgttcttgcgatagtttactgagaatgatggtttccaatttcatccatgtccctacaaaggacatgaactcatcactttttatggctgcatagtattccatggtgtatatgtgccacattttcttaatccagtctatcattgttggacatttgggttggttccaagtctttgctattgtgaatagtgtcgcaataaacatacgtgtgcatgtgtctttatagcagcatgatttatagtcctttgggtatatatccagtaacgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcgtctgttatttccttgagcagtggtttgtagttctccttgaagaggtccttcacatcccttgtaagttggattcctaggtattttattctctttgaagcaattgtgaatgggagttcactcatggtttggctctctgtttgtctgttgttggtgtataagaatgcttgtgatttttgtacattgattttgtatcctgagactttgctgaagtcgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcgtcaatgttcatcaaggatattggtctaaaattctcttttttggttgtgtctctgcccggctttggtatcagaatgatgctggcctcataaaatgagttagggaagattccctctttttctattgattggaatagtttcagaaggaatggtaccagttcctccttgtacctctggtagaattcggctgtgaatccatctggtcctggactctttttggttggtaaactattgattattgcctcaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctcttttttctttattactcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaactgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtgttgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggaattgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcttttggaggaggagaggcgctctgcgttttagagtttccagtttttctgttctgttttttccccatctttgtggttttatctacttttggtctttgatgatggtgatgtacagatgggttttctgttagatgtcctttctggttgttagttttccttctaacagacaggaccctcagctgcaggtctgttggaataccctgccgtgtgaggtgtcagtgtgcccctgctgtggggtgtctcccagttaggctgctcgggggtcaggggtcaaggacccaattgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgccagcaatcagcgagattccgtgggcgtaggaccctctgagccaggtgtgggatatagtctcctggtgcgccgttttttaagccggtctgaaaagcgcaatattcgggtgggagtgacccgattttccaggtgcgtctgtcacccctttctttgactcggaaagggaactccctgacccttgcgcttcccaggtgaggcaatgcctcgccctgcttcggctcgcgcacggtgcgcgcacacactggcctgtgcccactgtctggcactccctagtgagatgaacccggtacctcagatggaaatgcagaaatcacccgtcttctgcgtcgctcacgctgggagctgtagaccggagctgttcctattcggccatcttggctcctccctcctattataatctttcatttgtttcatcaatctagacatttataatgaatacagtataaaaagtagctctactggccaggcacagtggctcacgcctgtaatcccagca

SEQ ID NO: 12692 - DNA, 6641 bp, Homo sapiens
  misc_feature (44)..(44): n equals a,t,g, or c
tattattttactatttttttcttttcttttttttttttttttancagactctaagttttagggtacatgtgcacattgtgcaggttagttacatatgtatacatgtgccatgctggtgcgctgcacccactaatgtgtcatctagcattaggtatatctcccaatgctatccctccccccttccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtaatgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagtcctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatatgagctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccgtctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggaatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcattgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaaggttagtttggctggatatgaaattctgggttgaaaattcttttctttaagaatgttgaatattggcccccactctcttctggcttgtagggtttctgccgagagatccgctgttattctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccataattcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcgggcatcttggctcctccctctcttttttttaaaattatactttaagtcctagggtacatgtgcacaatgtgcaggtttgttacatatgtatacatgtgccatgttggtgtgctgcacccactaacttatcatttatattaggtatttctcctaatgctgtccctcccctctcctcacaccccacgacaggccctggtgtgtgatgttccctgcctggtgtccaagtgctctcattattcaattcccacctatgagtgagaacatgtggtgtttggttttctgtctttgcgatagcttgctcagaatgatggtttccagcttcatccatgtccctacaaaggacatgaactctcatccttttttgtggctgcatagtattccatggtgtatatgtgccacattttcttaatccagtctatcactgatggacatttgggttggttccaagtctttgctattgtgaatagtgccacaataaacatacgtgtgcatgtgtctttatagtagcgtgatttataatcctttgggtatatacccagtaatgggatcactgggtcaaatggtatttctagttctagatccttgaggaatcgccacactg

SEQ ID NO: 12693 - DNA, 6064 bp, Homo sapiens
ttttttttttcatatttacatttttattttatttttttttaatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtaatctcattgttcaattcccacctatgagtgagaatatgcggtgtttgctttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcattctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacgtatggctagccagttttcccaccaccatttattaaatagggaatcctttccccattgcttgtttttgtcaggtttgtcaaagatcagatagctgtagatatgtggcgttatttctgagggctctggtctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctgtcagcttaaggagattttgggcttgagacaatggggttttctagatatacaatcatgtcgtctgcaaacagggacaatttgacttcctcttttcccaattgaataccctttatttccttctcctgcctaattgcccaggccagaacttccaacactatgttgaataggagtggtgagagagggcatccctgtcttgtgccagttttcaaagggaatgcttccagtttttgcccattcagtatgatattggctgtgggtttgtcatagatagctcttattatttttgaaatacgtcccatcaacgcctaatttattgagagtttttagtatgaagggttgttgaattttgtcaaaggcttttttctgcatctattgagataatcatgtggtttttgtctgtggctctgtttatatgctggattacatttattgatttgcgtatattgaaccagccttgcatcccagggatgaagcccagttgatcatggtggataagctttttgatgtgctgctggattcgttttgccagtattttactgaggatttttgcatcaatgttcatcaaggatattggtctaaaattctctttttttgttgtgtctctgcctggctttggtatcagaatgatgctggcctcataaaatgagttagggaggattccctctttttctgttgattggaatagtttcagaaggaatggtaccagttcctccttatacctctggtagaattcggctgtgaatccatctggtcctgtactctttttggttggtaagctattgattattgccacaatttcagctcctgttattggtctattcagagattcaacttcttcctggtttagtcttgggagagtttatgtgcagaggaatttatccatttcttctagattttctagtttatttgcatagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcttttcaaaaaacaagctcctggattcattaatttattgaagggttttttgtgtctctgtttccttcagttctgctctgagtttagttatttcttgccttctgctagcttttgaatgtgtttgctcctgcttttctagttcttttaattgtgatgttaggttgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatatggggtggagagttctgtagatgtctattaggtctgtttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatgtccttctttgtctcttttgatctttgttggtttaaagtctgttttatcagagactaggattgcaacccctgcctttttttgttttccattggcttggtagatcttcctccatccttttattttgagcctctatgtgtctctgcacgtgagatgggtttcctgaatacagcacactgatgggtcttgactctttattcaatttgccagtctgtgtcttttaattggagcatttagtccatttacatttaaagataatattgttatgtgtgaatttgatcctgtcattatgatgttagctggttattttgctcgttagttgatgcagtttcttcctagtctcaatggtctttacattttggcatgattttgaagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgccttctcgaggagtatctttgtggtgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagtaatacattctcctaaatttttttcaaagttttcaactgctttgcctttggtttgaatgtcctcccgtagctcagagtaatttgatcatctgaagtcttctctcagcttgtcaaagtcattctccatccagctttgttccgttgctggtgaggaactgcgttcctttggaggaggagaggtgctctactttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggtgcctcccagttaggctgttctggggtcaggggtcagggacccacttgaggaggcagtctgcccgttctcagatttccagctgcgtgctgggagaaccacagctcttttcaaagctgtcagacagggacatttaagtatgcaaaagttactgctgtctttttgtttgtctgtgccctgcccccagaggtggagcctatagaggcaggcaggcctccttgagctgtggtgggctccacccagttcgagcttcccggctgctttgtttacctaagcaagcctgggcaatggcgggcacccctcccccagccttgctgccgccttgcagtttgatctcagactgctgtgctaacaatcagcgagactccgtgggcgtaggaccctccgagccaggtgcgggatataatcttgtggtgcgcagttttttaagcccgtccgaaaagcgcagtgttcgggtgggagtgacccgactttccaggtgccgtccatcacccctttctttgactcagaaagggaaccccctgaccccttgcgcttcccaagtgaggcagtgcctcgccctgcttcggctgaggcacggtgcgtgcgcccactgacctgcgcccactgtctggcactccctaatgagatgaacccggtacctcagatggaaatgcagaaatcacccgtcttctgcgtcgctcacgctgggagctgtagaccggagctgttcctattcggccatcttggctcctcccc

SEQ ID NO: 12694 - DNA, 22524 bp, Homo sapiens
cactttttgatgaggtttttttttttcttgtaaatttgtttaagttccttgcagattttggatattagccctttgtcagatggatagattgcaaaaattttctcccattctgtaggttgcctgttcactttgatgatcatttcttttgctgtgcagaagctctttagtttaattagaccccatttgtcaattttggcttttgttgcaattgcttttggtgttttagtcatgaagtctttgcccatgcctatgtcctgaatggtattgcctaggttttcttctagggttttttatggttttagttcttacatttaaatctttaatccatctttttttttaatttttttaatttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaactgtccccagagtgtgatattccccttcctgtgtccatgtgatctcattgttcaattcccacctatgagtgagaatatgcggtgtttggttttttgtccttgcgatagtttactgagaatgatgatttccaatttcatccatgtccctacaaaggacatgaactcatcattttttatggctgcatagtattccatggtgtatatgtgccacatattcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtgtttccagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtggtgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagcttcttttgctgtgcagaagctctttagtttaattagatcccatttgtcaattttgtcttttgttgccattgctttggtgttttagacatgaagtccttgcccatgcctatgtcctgagtggtattgcctaggttttcttcttgggtttttatggttttaggtctaacatgtaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtagcgttatttctgagggctctgttctgttccattgatctatatctctgttttggtaccagtgccatgctgttttggttactgtagccttgtagtatagtttgaagtcaggtagtgtgatgcctccggctttgttcttttggcttaggattgacttggcgatgtgggctcttttttggttccatatgaactttaaagtagttttttccaattgtgtgaagaaagtcattggtagcttgatggggatggcattgaatctgtaaattaccttgggcagtatggccattttcacgatattgattcttccttcccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctttctgtttgtctgttgttggtgtataagaatgcttgtgatttttgtacattgattttgtatcctgagactttgctgaagttgcttatcagcttaaggagatgttgggctgagacagtggggttttctagatatacaatcatgtcgtctgcaaactgggacaatttgacttcctcttttcctaattgaataccctttatttccttctcctgcctgattgccctggccagaacttccaacactatgttgaataggaatggtgagagagggcatccctctcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatgttgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttaggaaggattccctctttttctattgattggaatagtttcacaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtaatattctctgatggtagtttgtatttctgtgggatcggtggtgatatcccctttatcattttttattgcgtctatttgattcttctctctttttttctttattagtcttgctagcggtctatcaattttgtttatcctttcaaaaatccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagactctggtatgttgtgtctttattcttgttggtttcaaagaacatctttatttctgccttcatttcgttatgtacccagtagtcattcaggagcaggttgttcagtttccatgtagttgagtggttttgagtgagattcttaatcctgagttctagtttgattgcaatgtggtctgagagatagtttgttataatttctgttcttttacatttgctgaatagtctttacttccaagtatgtggtcaattttggaataggtgtggtgtggtgctgaaaaaaatgtatattctgttgatttggggtggagggttctgtagatgtctataggtctgcttggtgcagagctgagttcaattcctgggtatccttgttgactttctgtctcattgatctgtctaatgttgacagtggggtgttaaagtctcccattattattgtgtgggagtctaagtctctttgtaggtcactcaggacttgctttatgaatctgggtgctcctgtattgtgtgcatatatatttcggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgtgtttcctgaatacagcacactgatgggtcttgactctttatgcaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgaatttgcagtggctggtaccggttgttcctttccatgtttagcacttccttcaggagctcttttagggcatgcctggtggtgacaaaatctctcagcatttgcttgtctgtaaagtattttatttctccttcgcttatgaagcttagtttggctggatatgaaattctgggttgaaaattcttttctataagaatgttgaatatttgcccccagtctcttctggcttgtagggtttctgccgagagatccgctgttagtctgatgggcttccctttgatggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggttttgctcatttctttttattcttttttctctaaacttcccttctcacttcatttcattcatttcatcttccatcactgataccctttcttccagttgatctcattggctcctgaggcttctgcgttcttcacgtagttctcgagccttggctttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgtgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacattgccgtgtgaggtgtcagtctgcccctgctggggggtgcctcccagttaggctgctcgggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagattcccggctgctttgtttacctaagcaagcctgggcaatggcgggcgcccctcccccagccttgctgccgccttgcagtttgatctcagactgctgtgctagcaatcagcgagactccgtgggcataggaccctccgagctaggtgcaggatataatctcgtggtgcgccgttttttaagccagtcggaaaagcgcagtatttgggtgggagtgaccggattttccaggtgtgtctgtcacccctttctttgactcggaaagtgaactccctgaccccttgcgcttcccaagtgaggcaatgcctcgccctgctttggctcgggcacggtgcacacacccactgacctgcgcccactgtctggcactcccaagtgagatgaacccggtacctcagatggaaatgcagaaatcacctgtcttctgcatcgctcacgctgggagctgtagacaggagctgttcctattcggccatcttggctcctccctcctttaatccatcttgagctcatttttgtataaggtgtaaatgggtccagtttctgttttctgcatatggctagccagttttcccagcaccatttattgaatagggaatcctttccccattgcttgtttctgtcaggtttgtcaaagatcagatggttgtagatgtgtggtggtatttctgaggcctctgttctgttccattggtctatatatctgtttcattaccagtaccatgttgttctggtgactgtagccttgtattatagtttgaagtcaggtagcgtgatgccttcagcttcgttctttttgtttaggattgtcttggttatatgggctcttttttggtaccacatgaactttaaagtagttttttctaattctgtgaaaaaagtcaatggtagtttgatgaggatagcactgaatttataaattatttgggcagtatgaccattttcacaatattgattctttccatccatgagcatggaaagttttttcatttgtttgtgtcctctcttatttccttgagcagtggtttgtagttctccttgaagaggtccttcatatcccttctaagttgtattcctaggtattttattttctttgtagcaattgtgaatgggagttcactcatgatttggctctctgcttgtctattatttgtgtacaggaatgcttttgagttttgcacgttgattttgtatcctgagactttgctgaagttgtttttcagcttaaggagtttttcgggctgagacaatggggttttctaaatatacaatcatgtcatatgcaaacagagacaatctgatttcctcttttcctatttgaataccatttatttatttctcttgcctgattgccttggccacagcttccaatactattttgaataataggagtggtgacagagggcatccttgtcttgtgtcagttttcagagggaatgcttccaggttttgcccattgagtatgatattggctgtgagtttatcataaatagctcttattattttgagatgtgtttaatcaataccaagtttattgagtgtttttagcatgaaggggtgttgaattttattgaaggccttttctgcatctattgagataatcatgtggtttttgtcattggttttgtttatatgatggattacatttattgatttgtgtatgttgaagcagccttgcaccccaggtatgaagccaacttgatcatggtggataagttttttaatgtgctgctggattctgttttccagtattttattgaggattttcacatggatgttcatcaagaatattggcctgaaatttttttgtgtgtgtgtctctgccaggctttggtatcaggatgatgttggcctcataaaatgaattagggaggactccctcttttttttttgattggaatagtttcagaaggagtggtacaagctcctccttgtacctctggtagaattcagctgtgaatccatctggtcctggactttttttggttggtaggctattaattattgcctcaatttcagaggctgttattggtctattcagggattcaacttcttcctggtttagtcttgggagagtgtatgtgtcaaggaatttatccatttcttctagattttctagtttatctgtgtagaggtgtttatagtattctctgatgatagtttgtatttctgtgggatcggtggtgatatcccctttataattttttactgcatctatttgagtcttctctcttttcttctttattagtcttgctagcggtctatcaattttgtttatcctttcaaaaatccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttccttctttttcttgtgcacatttagtgtcataaatttccctctacacactgctttaaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgcgtgaatttattaatcctgagttctagtttgattgcactgtggtctgagaaagagtttgttataatttctgctcttttacatttgctgaggagtgttttagttccaactatgcggtcagttttggaataagtgtgatgtggtgctgagaagaatgtattttctgttgatttggggtggagggttctgtagatgtctattaggtctgcttggtgcagagctgagttcaattcctgaatatccttgttaactatctgtctcattgatctgtctaatgttgatagtggggtgttgaagtctcccattagtattgtgtgggactctaagtctctttgtaagtctctaaggacttgctttatgaatctgggtgctcctgtattgggtgcatatatatttaggatagttagctcttcttgttgaattgatccctttaccattatgtaatggccttctttgtctctttgatctttgttggtttaaagtctgttttatcagagactaggattgcaacccctgcctttttttgttttccatttgcttggtagatcttcctccattcctttattttgagcctgtgtgtgtctctgcatgtgagatgggtctcctgagtacagcacactgatgggtcttgaatttttatccaatttgccactctgtgtcttttaattggagcatttagcccacttacatttaaagttaatattgttgtgtgtgaatttgatcctgtcattatgatgttagctggttattttgcttgttagttgatgcagcttcttcctggcattgatggtctttacattttggcatgtttttgcagtggctggtaccgattgttcctttccatgtttagtgcttccatcaggagctcttttagggcaggcctggtagtgacaaaatctctcagcatttgcttgtctgtaaagtattttatttcttcacttatgaagcttagtttggctggatatgcaattctgggttgaaaattcttttctttaagaatgttgaatatttgcccccactctcttctggcttgtagagtttctgttgagagatccactgttactctgatgggcttccctttgatggtaacccaacctttctctctggctgcccttaacattttttccttcattttaactttgttgaatctgaaaattatgtgtcttggagttgctgttctcaaggagtatctttgtggtgttctctgtatttcctgaatttgaatgttggcctgccttgctaggttgggcaagttcccctggataatatcctgcagagtgttttccaacttggttccattctccttgtcactttcaggtacaccaatcagatgtagatttggtcttttcacatagtcccatatttcttggaggctttgttcatttctttttactcttttttctctaaactccttttctcacttcatttcattcgtttgatcttcaatcactgataccctttcttccagttgatcgaatcagttactgaagcttgcacattcatcacatagttcttgagccatggttttcagctccgtcaggtcgtttagggacttctctatgctggttattcagtcagccattcacctaatcttttttcaaggtttttatcttgtttgcaatgggatcaaacttcctcctttagctcggagaaggttgatcatctgaagctttcttctctcaacttgtcaaagtcactctccatccagctttgttctgttgctggcaaggagctgccttcctttggagggggagaggtgctctgatttttagagtttccagtttttctgctctgtcttttccccatctttgtggctttatctacttttggtctttgatgatggtgacatacagatggggttttggtgtggatgtcctttctgtttgttttccttctaacagtcagaaccctcagctgcaggtctgttggagtttgctggaggtccactccagaccctgtttgccagggagagcctcccaattaggctacttgggggtcagggacccacttgaggaggcagtctgtccattctcagatctcaaactccatgctgggaaaatcagtactgtcttcaaagctgtcagacagggacatttaaatatgcagaggtttctgcttccttttgttcagctatgccctgcccccagaggtggagtctacagaggcagtcaggtcttcttgagctgtggtgggctccacccagtttgagattcttggccgctttgtttacctactcaagcctcagcaatggcagtcacccctccccccagcctcactgccaccttgtagttagatctcagactgctgtgctagtaatgagtgaggctctgtgggcatgggaccctctgagccaggcacgagatatattttcctggtgtgctgtttgctaagaccattggaaaagtgcactattagggtggtagtgacccaattttccaggtgctgtctgtcatggcttcccttggctaggaaagtgagttcccttaccccttgcacttcccaggggaggtgatgcctcaccctgccttggctcttgcttggtgggctgcacccactgtcctgcacccactgtctgacacgccccagtgagatgaacctggtacctcagttggaaatacagaaatcacctgtcttctgcgtcactcatgctgggagctgtagactggagctgttcctattcggccatcttggaaccactatgtggtcgattttagaataagtgctatgtggtgctgagaagaatgtatattctgtttatttgaggtggagagttctgtagatgtttattaggcccacctggttcagagctgagttcaagtgctgaatatccttgttaattttctctctcattggtctgtctaatattgacagtggggtattaaagtctcccactattattgtgtgggagtctaagtctctttgtaggtctctaagaacttgctttatgaatctgcgtgctcctgtattataaagtctgttttatcagagactaggattgtaaactctgtttttttttctttccatttgcttggtaaatatttctccatccctttattttgagcataagtgtgtctttgcacttgagatgggtctcctgaatacagcacactgatgagtcttgactcttcatccaatttgcccatctgtgcctattaattggggcatttagcccacttacctttaatgctaatattgttatgtgtgaatttgatcctgtcattatggtgctagcaggttattttccccattagttgatgcggtttcttcatagtgtcgatggtctttacattttggtttgtttttgcagtggctggtaccagtttttcctttccatatttagtgcttccttcaggagctctttaaggcacacctgatggtgacaaaatccctcagcacttgcttgtctgtaaaggattttatttctccttcacttatgaagcttagttggctggatatgaaattctgggttaaaaattttttctttaataatgttgaatattagcccccactctcttctggcttgtagggtttctgctgagagatctgctgttagtctgatgggcttccctttgtgggtaacctgacttttctctctggctgcccttaacattttttccttcatttcaaccttggtgaatatgatgattatgtttcttggggttgctcttctccaggagtatctttgtggtgttctctctatttcctgaagttgaatgttggcctgccttgctacgttggggaagttctcctggataatgtcctgaagagtgttttctaacttggttccattctcccatcactttcaggtacaccaatcaaacatagatttggtcttcatatagtctcatgtttattggaggctttatttgtttcttttcacccttgtttctctagtcttgtcttctcactttatttcattaatttgatcttcaatcactgatatccttacttccacttgatctaatcggctattgaagcttgtgtatgcttcatgaaggtctcatactgtggttctcagctccatcaggccatttaagctcttctccttactggtattctagttagccattcgtctaaccttttttcaaagtttagtttccttgcaatgggttagaacatgctcctttagctcagagaagtttgttattaccgaccttctgatgactacttttgtcaatttgtcaaactcattctccatccagttttattcccttgctgttgaggagttgtgttcctttggaggagaagaggtattttggttttggaattttcagcctttctgctctggtttctccccatttttgtggtttttgtctacgtttggtctttgatgttggtgacctatggatggggttttgttgtggatgtcctttttgttgatgttgatgctattcctttctgtttgttagttttccttctaacagtcaggcccctcatctgcaggtctgttggagtttgctggaggtccactccagaccctggagtattaccaggtttgcctgggtatttccagtggaggttgcagaacagcaaatattgctgcctgatcctttctctggaagctttgtcccagagggacacctgcctgtatgaggtgtctgtcggcccctactgtgaggtgtctccccatcaggaatcatggggtcatggacccacttgaggaggcagtctgtccattatcagagcttgaactctgtgctgtgagaaccactgctcttttcagagctgttaggcagggaggtttaagtctgcagaagctgtctcctgccttttgttcagatatgccctgcccctagaggtggaatctagagaggcagtaggccttgctgagctgtggtgggctccgcccagtttgaagttccctgttgctttgtttacactgtgggcatagaactgcctactcaagcctcagtagtagtggatgcccctccccctgccaagctccaacatcccaggttgatctcagactgctgcattagcagcgagcaaggctccatgggtgtgggacctgtctagtcaggcttgggagggaatctcctggtctgctggttgtgatgaccctgggaaaagtgcagtatttgggcaggagtgtaccattcctccaggtacagtcactcccagctttccttggctaggaaagggaaatcccccaaccccttgcacttcctgggtgaggtgatgccctgccctgctttggctcaccctccatgggctgcacccactgtccaaccagtcccaatgagatgaaccaggtacctcagttggaaatgcagaaatcacccatcttctgcatcgatctcactgggagctgtagactggagctgttcctattaggccatcttggaagtgacctatctcaaacttttaaccgtttctttccagaagaaaaatttgaaacattaagggaaaacagttgggtaaaatatccatttgcttttcaaaaccctgaatcaataattgagctaaacttggtgcctgaagaagagaatgaattattgcagtttagttcttcatatacattaaagaatgattatgagaccttaagcttatcagcattttggaataaggtaaaggaagactttccattgttaaatagaaagagtgtcctgctattactaccattcacaacaactagtttgtgtgaactagggttttctatcttaacccagttaaaaacaaaggaaagaaatggctgaatggtgtagcagctatgcaggtagcattatcttcctatgttccagactggaatgaacttaggaacaggcaagcacacccatcataataaataaaatcttacctaaaaaaagatgtacaaatggctaataggtatatgaaaatctgctcaacatcacctattacaagggaagtgcaaatcacttgaatgggagaaaatatttgcaaagtgctcatccaaaggggactaatatgtattctatacaagaataacaattcaactatagaaaaccaaacaatcccactaaaaatgaacaatatttttcaaaagaagacttacaaaagaccaatagtatatgaaaaatgctcaacactaattatcagggattgtaaataaaaaccacaatgagatattatctcaccacagaatgtttattattgacagatgcacacactcacacagacacacacacacccagatgctggtgagggtgcagagaaaagggtactcttagacatggtgggaatgtaaattagtgcaaccattatggaaagcagtatagatatttctcagaaaaactaaatctagaactactacatgatgcagcaatctcactacagggtatctatccaaaagaaaagaaattattttctcaaagggatacatttgactcacaggtttatcacaatgctattcccaatagaacagatatggaatcaacctaagtgttcatcaatggctgattggacaagaaaaatggtgtgtgtgtgtgagtgtgtgtgtgcacatgcatgcatgtacatgtatgtgtttatatgtactatttgttttctggatacacacctacacccacacccataggtacccatacctgcacaaatacccatacacatatatacacatacactattcagccattaaaaagagtggaatccttttccagcaacatggatggaaatgggttttattatgataagtgacgtaagggaagcacaaaaagataaataccacatgttctcactcatatgtgggatgtaaaaacttgatctcatggacatcaagaataggatagatatcagaaactgggaaagggaggtgaagagaggttgtttatggatacaaacatgcagttagattgaagaaatcatcctaatgtttgatagcagactagggtgaccatatgtagcaatactattatgtatattgcaaagtaactagaagactagaaatgataaaacacctaaaaatgataaacatgcatacatgcatggtgatggataccccaaattaccctggcttgattatcactcattccatgcatgtaacaaacgctcacatatacccaataaacatgtaaatataatgtgtcaatgaaaaaactctaaaatgttgatttgacatataataaagcttacttgtcagtgaaaagattaaactcccacgaaaaaagttatcttatgcaaacaagagaatttgacttcttcctttccaatttggattccctttatttgtttctcttgcctaattgctctggctgggacttttgatattatgttgaataaaagtggtaaaagcgggcatccttgttttgtttaagaccttagaagaaaggctttccatttttccctgttcagtataatgttagctgtgggtttgtgacatatggcctttattattttgaggtatgttccttctatacttagtttgttgaggatatttttcataagaggatgttgagttttgtcaaatattttttcatcatttatttaaatctatttaattcttggttctgttaatgtgatgtatcatgtttattgatttgcacgtgttgaactatccttgtattcctgggaggaatcccccttgatcatggtgaatgatcttttaaggtgttgatgaatttggtttgctagtattttgttgaggattttgcatatatgttaataatactggcttttagttttcttttttcatgtgtccttgcctggttttggtgtcagggtaatgctgccatgttagaatgagtttggaagcattccttgctgtttaatttttttgaaggattttagtagactcaattcatatttgttgttcttttgatgtttggtagaattcatcagtgagtctatctggtcctgggattttctttgaagtgagaattttattatgaccttactcttgttactcattattaatttgttgaggttttatgtttttttcttggttcaatcttggtaggtttatatgtctggtaatttatccattacttttaggtttccaaattgtcatatagttgttcataatagtcactaatgattctttgtatgtctgtggtctcagttgttgtctcctttttcaattctgattttgtttgtttgggtcttctctacgatttttttggttggttgattagtggctttagaacagttctcttgattttcttgtcaggtggattttatgtctgcatccgtttagtgccaattactggtatgttgttttgtttgtttggtgacatcgtttttcttttttttaaatatttttttattttgttattattatactttaagttttagggtacatgtgcacaatgtgcaggttttgttacctctgtatacatgtgccatgttggtgtactgcaccccttaactcgtcatttagcattaggtatatctcctaatgctatccctcccctctccccccaccccacaacagtccctggagtgtgatgttccccttcctgtgtccatgtgttctcattgttcaattcccacctatgagtgagaacatgtggtgtttggttttttgtctttgcgatagtttgctgagaatgatggtttccatcttcatccatgtccctacaaaggacatgaactcatcattttttaatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaaatagtttacagtcccaccaacagtgtaaaagtgttcctatttctccacatcctctccagcacctgttgtttcctgactttttaatgatctccattctaactggtgtgagatggtatctcattgtggttttgatttgcatttctctgatggccagtgatgatgagcactttttcatgtgttttttggctgcataaatgtcttcttttgagaagggtctgttcatatacctcacccactttttaatggttgtttttttcttgtaaatgtgtttgagttcattgtagattctggatattagccctttgtcagatgagtagattatgaaaatgttctcccattttgtaggttgcctgttcactctgatggtagtttcttttgctgtgcagaagctctttagtttaattaaatcccatttgtcaattttgtcttttgttgccattgcttttggtgttttagacatgaagtccttgcccatgcctatgtcctgaatggtattgcctaggttttcttctagggtttttatggttttaggtctaagatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagaacagatagttgtagatatgtgtaattaattctgagggctctgttctgttccattggtctatatctctgttctggtaccagtatcatgctgttttggtgactgtagcaccagtatcatgctgttttggtgactgtagccttgtagtagagtttgaagtcaggtagtgtgatgcctccagctttgttcttttggcttaggattgacttggtgatgcgggctcttttttggttccatatgaactttaaggtagttttttccaattctgtgaagaaagccattggtagcttgatggggatggcattgaatctgtaaattaccttgggcagtacggtcattttcacgatattgattcttcctacccgtgtgcatggaatgttcttccatttgtttgtatcctctttgatttcattgagcattggtttgtagttctccttgaagaggtccttcacatcccttgtaagttggattcctaggtattttattctctttgaagcaattgtgaatgggagttcactcatgatttggctttctgtttgtctgttattggtgtataagaatgcttgtgatttttgtacattgattttatatcctgagactttgctgaagttgtttatcagcttaaggagattttgggctgagacgatggggttttctagatatacaatcatgtcatctgcaaacagggacaatttgacttcctcttttctgaattgaataccctttatttccttctcctgcctgattgccctgccagaacttccaacactatgttgaataggagtggtgagagaaggcatccctgtcttgtgccagttttcaaagggaatgcttccagtttttgcccattcagtatgatattggctgtgggtttctcatagatagctcttattttgagatacgtcccatcaatacctaattttttgagagtttttagcatgaagcattgttgaattttgtcaaaggccttttctgcatctattgagataatgatgtggtttttgtctttggttctgtttatatgctggattacatttattgatttgcgtatgttgaaccagccttgcatcccagggatgaagcccaattgatcatggtggataagctttttgatgtgctgctggattcggtttgccagtattttattgacgatttttgcatcaatgttcattaaggatattggtctaaaattctcttttttggttgtgtctctgcccggctttggtatcaggatgatgctggcgtcgtaaaatgagttagggaggattccctctttttctattgattggaatagtttcagaaggaatggtaccagttcctccttgtacctctggtagaattcggctgtgaatccatgtggtcccagtaatgggatggctgggtcaaatggctggctggcttaccaactctttttggttggtaagcacaatttcagagcctgttattggtctattcagagattcaacttcttcctggtttagtcttgggagggtgtatgtgtcaaggaatttatccatttcttctagattttctagcttatttgtgtagaggtgtttgtagtattctctgatggtagtttgtatttctgtgggatcagcggtgatatctcctttatcattttttattgcatctatttgattcttctctcttttcttctttattagtcttactagcagtctatcaattttgttgatcttttcaaaaaaccagctcctggattcattaattttttgaagggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctcagcacactgctttgaatgtgtcccacagattctggtatgttgtgtctttgttctcgttggtttcaaagaacatctttatttctgccttcatttcgttaggtacccagtagtcattcaggagcaggttgttcagtttccatgtagttgagtggttttgagtgagtttcttaatcctgagttctagtttgattgtactgtggtctgagagacagtttgttataatttctgttcttttacatttgctgaatagtgctttacttccaactatgtggtcaattttggaataggtgtggtgtggtgctgaaaaaaatgtatattctgttgatttggggtggagagttttgtagatgtctattaggtccgcttggtgcagagctgagttcaattcctgggtatccttgttaactttctgtctcactgatctgcctaaggttgacagtggggtgttaaagtctcccattattattgtgtgggagtctaagtctctttgtatacctctaaggacttgctttatgaatctgggtcctcctgtgttgggtgcatatatatttaggatagttagctcttcttgttgaattgatccctttaccattatgtaatggccttctttgtctcttttgttctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctatccaatttgccactctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctgataccggttgttcctttccatgtttagtgcttccatcaggagctcttttagggcaggcctggtggtgacaaaatctctcagcatttgcttgtctgtaaagtattttatttctccttcacttatgaagcttattttggctggatatgcaattttgggttgaaaattcttttctttaagaatgttgaatatttgcccccagtctcttctggcttgtagggtttctgccgagagatccgctgttagtctgatgggcttccctttgatggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggttttgctcatttctttttattcttttttctctaaacttcccttctcacttcatttcattcatttcatcttccatcactgataccatttcttccagttgattgcatcagctcctgaggcttctgcattctttatgtagttctcgagccttggctttcagctccatcagcccctttaagcacttctctacattggttattctagttatacattcgtctaattttttttcaaagtttttaacttctttgccgttggtttgaatttcctcctgtagctcggagtagtttgattgtctgaagtcttcttctctcaactcgtcaaagtcattctccatccagctttgttctgttgctggtgaggaactgcgaacctttggaggaggagaggtgctctgctttttagagtttccagtttttctgttctgttttttccccatctttgtggttttatctacttttggtctttgatgatggtgacatacagatgggtttttggtgtggatgtcctttctgtttgttagttttccttctaacagacaggaccctcagctgcaggtctgttggagtttgctagaggtccactccagaccctgtttgcctgggtatcagcagtggtggctgcagaactggattttcatgaaccgcaaatgctgctgcctgatcggtcctctggaagttttgtctcagaagagtatccggccgtgcgaggtgtcagtctgcccctactggggggtgcctcccagttaggctgctcgggggtcagggacccacttgaggaggcagtctgcccattctcagatctccaggtgcgtgatgggagaaccactactctcttcgaagctgtcagacagggatgtttaagtctgcagaggttactgctgtctttttgtttgtctgtgccctgcccccagaagtggagcctacagaggcaggcaggcctccttgagctgtggtgggctccacccagttcgagcttcctggctgctttgtttacctaagcaagcctgggcaatggcaggtgcccttcccccagcctcactgctgcct

SEQ ID NO: 12695 - DNA, 5966 bp, Homo sapiens
gggctattttcttttctttttctttttttttttaattatactttaagttttagggtacatgtgcacaacgtgcaggtttgttacatacgtatacatgtgccatgttggtgtgctgcacccattaactcgtcatttacattaggtatatctgctaatgctatccctccccgctccccccaccccacaacaggccccagtgtgtgatgttcccgtttctgtgtccaagtgttctcattgttcaattcccacctatgagtgagaacatgcagtgtttggttttttgtccttgggatactttgctgagaacgatggtttccagcttcatccatgtccctacaaaggacataaactcatccttttatatggctgcatagtattccatggtgtatatgtgccacattttcttaatccagtctgtcattgatggacatttgggttggttccaagtctttgctattgtgagcactgctgtaataaacatacgtgtgcatgtgtctttatagcagaatgatttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtatgagatagtatggcattgtggttttgatttgcatttctctgatggccagtgatgatgagccttttttcatgtgtcttttggctgcataaatatcttcttttgagaagtgtcgttcatatcctttgcccactttttgatggggttgtttgattttttcttgtaaatttgtttgagttcattgtagattctggatattagccctttgtcagatgagtagattgcaaaaattttctcccattctgtaggttgcctgttcactctgatggtagtttctttggctgtgcagaagctctttagtttaattatatcccatttgtcaattttggcttttgttgccattgcttttggtgttttagacgtgaagtccttgtccatgcctatgtcctgaatggtattgcctaggttttcttctagggtttttatggttttaggtctaacatttaagtctttaatccatcttgaattaatttttgtataaggtgtaaggaaggggtccagtttcagctttctacatatggctagccagttttcccagcaccatttattaaatagggaatcctttccccattgcttgtttttgtcaggtttgtcaaagatcagatagttgtagatgtgtggcattatttctgagggctctgttctgttccattggtctgtatctctgttttggtaccagtaccatgctgctttggttactgtagtcttgtagtatagtttgaagtcaggtagcatgatgcctccagctttgttcttttggcttaggattgacttggtgatgcgggctcttttttggttccatatgaactttaaagtagcttttttccaattctgtgaagaaagtcattggtagcttgatggggatggcattgaatctataaattaccttgggcagtatggccattttcactatattgattcttcctacccatgagcatggaatgttcttccatttgtttgtatcctcttatttccttgagcagtggtttgtagttttccttgaagaggtccttcacatcccttgtaagttggattcccaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagatttggggctgagatgatggggtcttctagatacacaatcatgtcatctgcaaacagggacaatttgacttcctcttttcctacttgaataacctttatttccttctcttgcctgattgccctggccagaacttccaacactatgttgaataggagtagtgagagagggcatccctgtcttatgccagttttcaaagggaatgcttccagtttttgcccattcagtatgatattggctgtgggtttgtcataaatagctcccattattttgagatatgtcccatcagtaccaatttattgagagtttttagcatgaagggttgttggattttatcaaaggccttttctgcatctgttgagataatcatgtggtttttgtctttggttctgtttatatgctggattatgtttattgatttgcatatgttgaaccagccttgcatcccagggatgaagcccacttgatcatggtggataagctttttgatgtgtttgctggattcggtttgccagtattttattgatgatttttgcatcgatgttcatcagggatattggtctaaaattctctttttctgttgtgtctctgccaggctttggtatcaggatgatgctggcctcataaaatgagttagagaagattccctctttttctattgattggaatagtttcagaaggaatggtaccagctcctccttgtacctctggtagaatttggctgtgaatctgtctggtcctggactttttttggttggtaagctattaattattgcctcaatttcagagcctgttattggtctattcagagattcaacttcttcctggtttagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagtggtctgtcaatgttgttgatcttttaaaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtggtgttagggtgtcaattttagatctttcctgctttctcttgtgggcatttagtgctataaatttccctctacacactgctttaaatgtctcccagagattctggtatgttgtatctttgttctcattggtttcaaagaacttctttatttctgccttcatttcgttatgtacccagtagtcattcaggagcaggttgttcagtttccatgtagttgagcggttttgagtgagtttcttaatcttgagttctagtttgatcgcactgtggtctgagagacagtttgttatcatttctgttcttttacatttgctgaggagtgctttacttccaactatgtggtcaattttggaacaagtgcggtgtggtgctgagaagaatgtatattttgttgaattggggtggagagttctgtagatgtctattagctccacttggtgcagggctgagttcaattcctggatatctttgttaactttctgtcttgtggatctgtctaatgttgacagtgggtgttaaagtctcccattattattgtgtgggagtctaagcctcttcgtaggcctctaaggacttcctttatgaatccgggtgctcctgtactgggtgcatatatatttaggttagttagctcttcttgttgaattgatccctttaccattatgtaatggccttctttgtctcttttgatctttgttggtttaaagtctgttttatcagagactagggttgcaacccctgccttgttttgttttccatttgcttggtagatcttcctccatccctttattttgagcctgtgtgtctctgcacgtgagaagggtttcctgaatacagcacactgatgggtcttgactctttatccaacttgccagtctgtgtcttttaattggagcatttagcccatttacatttaaggtttatattgttatgtgtgaatttgatcctgtcattgagatgttagctggttattttgctcgttagttgatgcagtttcttcctaaccttgatggtctttacgatttggcatgtttttgcagtggctggtaccagttgttcctttccatgtttagtgcttccttcaggagctcttgtagggcaggcctggtggtgacaaaatctctcagcatttgcttgtctgtaaaggattttatttctccttcacttatgaggcttagtttggctggatatgaaattctgtgttgaaaattcttttctttaagaatgttgaatattggcccccactctcttctggcttgtagaatttctgccgagcgatcagctattagtctgatgggcttccctttgtgggtaacccgacctttgtctctggctgcccttaacattttttccttcatttccactttggtgaatctgacaattaagtgtcttggagttgtccttctcaaggagtatctttgtggacttctctgtatttcctgaatttgaatgttagcctgccttgctggattggggaagttctcctgcataatttcctgcagagtgttttccaacttggttccattctccccgtcactttcaggtacaccaatcagatgtagatttggtcttttcacatagtcccatatttcttggagggtttgtttgtttctttttattcttttttctctaaacttctcttctcacttcatttcattcatttgatcttccatcaagataccctttcttccagttgatcgaattggttagtgaggcttgtgcattcatcatgtagttctcgtgccgtggttttcagctccatcaggtcctttaaggacttctgtgtattagttattctagttagccatttgtctaatcttttttcaaggtttttgacttctttgccatgggtttgaacttcctcctttagctcggagaagtttgatcgtctgaagccttcttctctcaactcatcaaagtcattctccatccagctttgttccgctgctggtgaggagctgcgttcctttggagaagaagaggttctctgatttttagaattttcagtttttctgttctgttttttccccatctttgtggttttatctacctttggtctttgatgatggtgacatgcagatggggttttggtgtggatgttctttctgtttgttagttttccttctaacagtcaggaccctcagctgcaggtctgttggagtttgccagagctcaactccagaccctgtttgcctgggtatcagcagcggaggctgcagaacagcgaatattggtgaacagcaaatgctgctgtctgatcgttcctctggaaattttgtctcagaggggtacctggccgtgtgaggtgtcagtctgcccctactggggggtgcctcccagttaggctactcgggggtcagggacccacttgaggaggcagtctgtccgttctcagatctcaagctgcatgctgggagaaccactgctgtcttccaatctgtcagacagggacatttaagtctgcagaggtttctgctgccttttgtttggctatgccctgctgccagaggtggagtctacaagaggcaggcaggcctccttgagctgtggtgggctccacccagttcgagcttcctggctgctttgtttacctactgaagtctcagcaatggcgggcgcccctcccccagccttgctgccgccttgcagtttgatctcagactgctgtgctagcaatgagcgaggctccgtgggcgtaggaccctctgagccatgcgcgggatataatctcctggtgtgccgtttgctaagaccatcggaaaagtgtagtattagggtgggaatgacccaatttttcagatgctgtctgtcacccctttccttggctagaaaagggaattccctgaccccttgtgct

SEQ ID NO: 12696 - DNA, 6410 bp, Homo sapiens
atttttttttaaattttattattattacagtttaagttttagggtacatgtgcacaatgtgcagcttagttacatatgtatacatgtgccatgctggtgtgctccacccattaactcgtcatttagcattaggtatatctcctaatgctatccctccctccttcccccaccccacaacagtccccagagtgtgatgttccccttcctgtgtccatgtgttctcattgttcaattcccacctatgagtgagaacatgcggtgtttggttttttgtccttgtgatagtttactgagaatgatgatttccagtttcatccgtgtccctacaaaggacatgaactcatcatcttttatggctgcatagtattccatggtgtatatgtgccacattttcttaatccagtctatcattgttggacatttggcttggttccaagtctttgctattgtgaatagtgctgcaataaacatacgtgtgcatgtgtctttatagcagcatgatttataatcctttgggtatatacccagtaatgtgatgactgggtcaaatggtatttctagttctagatccctgaggaatcgccacaccgacttccacaatggttgaactagtttacactcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtgttttttggctgcataaatgtcttcttttgagaagtgtctgttcatgttcttcacccactttttgatggggttgtttgtttttttcttgtaaatttgtttgagttctttgtagattccggatattagccctttgtcagatgagtaggttgcgaaaattttctcccattctctaggttgcctgttcactctgatggtagtttcttttgctgtgcagaagctctttagttgaattagatcccatttgtcaactttggcttttgttgccattgcttttggtgttttagacatgaagtccttgcccatgcctatgtcctgaatggtattgcctaggttttcttctagggtttttatggttttaggtcaaacgtttaagtctttaatccatcttgaattaatttttgtataagatgtaaggaagagatccagtttcagctttctccatatggctagccagttttcccagcaccatttattaaatagggaatcctttccccattgattgtttttctcaggtttgtcaacgatcagatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctagatattttattctctttgaagcaattgtgaatgggagttcactcatgatttggctctctgtttgtctgttattggtgtataagaaagcttgtgatttttgtacattgattttgtatcctgggactttgctgaagttgcttatcagcttaaggagattttgggctgagacaatggggttttctagatatacaatcatgtcatctgcaaacagggacaatttgacttcctctttttctaattgaataccctttatttccttctgcctaattgccctggccagaacttccaacactatgttgaataggagtggtgagagagggcatccctgtcttgtggcagttttcaaaggaaatgcttccagtttttgcccattcagtatgatattggctgtgggtttgtcatagatagctcttattattttgagatacgtcccatcaatacctaatttattgagagtttttagcatgaagtgttgttaaattttgtcaaaggccttttctgcatctattgagataatcatgtggtttttgtctttggctctgtttatatgctggattacatttattgatttgcatatattgaaccagccttgcatcctagggatgaagcccacttgatcatggtggataagctttttgatgtgctgctggattcagtttgccagtattttattgaggatttttgcatcaatgttcatcaaggatattggtctaaaattctcttttttggttgtgtctctgccaggctttggtatcaggatgatgctggcctcataaaatgagttagggagggttccctctttttctattgattggaatagtttctgaaggaatggtaccagttcctccttgtacctctggtagaatttggctgtgaatccatctggtcctggactctttttggttggtaagctattgattattgccacaatttcagatcctgttattggtctattcagagattcagcttcttcctggtttagtcttgggagggtgtatgtgtcgaggaatttatccatttcttctagattttctagtttatttgcgtagaggtgtttgtagtattctctgatggtagtttgtatttctgtgggatcggtggtgatgttccctttatcattttttattgcatctatttgattcttctctgttttcgtctttattagtcttgctagcggtctatcaattttgttgatcctttcaaaaaaccagctcctgaattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctgtcctgctttctcttgtgggcatttagtgctataaatttccctctacacactgctttgaatgtgtcccagagattctggtatgttgtgtctttgttctcattggtttcaaagaacatctttttttctgccttcatttcattatatacccagtagtcattcaggagcaggttgttcagtttccatgtagttgagtggttttgagtgagtttcttaatcctgagttctagtttcattgcactgtggtctgagagacagtttgttataatttctgttcttttacatttgctgaggagagctctacttccaactatgtggtcaattttggaataggtgtggtgtggtgctgaaaaaaatgtatattctgttgatttggggtgcagagttctgtagatgtctattaggtccgcttggtgcagagctgagttcaattcctggatatccttgttaactttctgtttcgttgatctgtctaatgttgacagtggggtgttaaagtctcccattattattgtgtgggagtctaagtctctttgtaggtccctcaggacttgctttatgaatctgggtgctcctgtattgggtgcatatatatttaggatagttagctcttcttgttgaattgatccctttaccattatgtaatggccttctttctctcttttgacctttgttggtttaaagtctgttttatcagacactaggattgcaacccctgcctttttttgttttccatttgcttggtagatcttcctccatccttttattttgagcctatttgtgtctctgcacgtgagatgggtttcctgaatacagcacactgatgggtcttgaccgtttatccaatttgccagtctgtgtcttttaattggagcatttagtccatttacatttaaagttaatattgttatgtgtgaatttgatcctgtggttatgatgttagctggttatcttgctcgttagttgatgcaggttcttcccagcctcgacggtctttacaatttggcatgtttttgcagtgggtggtacggtttgttcctttccatgtttagtgcttccttcaggagctcttttagggcaggcctggtggtgagaaaatctctcagcatttgcttgtctgtaaaggattttatttctccttcacttatgaagcttagtttggctggatatgaaattctgggttgaaaattcttttctttaagaatgttgactattgtcccccactctcttctggcttgtggagtttctgccgagagatccgctgttagtctgatgggcttccctttgtgggtaacccggcctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccatcctccccgtcactttcaggtacaccaatcagacgtagatttggtcttttcacatagtcccatatttcttgaaggctttgttcgtttctttttattcttttttctctaaacttcccttctcacttcatttcattcatttcatcttgcatcactgataccctttcttccagttgatcgcattggctcctgaggcttctgcattcttcatgtagttctcgatccttggctttcagctccatcagctcctttaagcacttctctctattgattattctagttatacattcgtctaaatttttttcgaagtatttaacttctttgccttcggtttgaatttcctcctgtagctcggagtactttgattgtctgaagtcttcttctctccactcgtcaaagtcattctccgtccagctttgttccattgctggtgaggaactgcgttcctttggaggaggagaggcactctgctttttagagtttccagtttttttgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtatcagcagcggtagcttcagaactgcggattttcatgaaccacgaatgctgctgtctgatcgttcctctggaagttttgtctgaaaggagtacccggccgtgtgagatgtcagtctgcccctactggggggtgcctcccagttaggctgctcgggggtcaggggtcagggacccacttaaggaagcagtctgcccattctcagatctccagctgtgtgcttggagaaccactactctcttcaaagctgtcaaacagggacatttaagtctgcagaggttactgctgtctttttgtttgtctgtgccttgcccccagaggtggagcctacaaaggcaggcaggcctccttgagttgtggtgggctctacccagttcgagcttcccggctgctttatttacctaagaaagcctgggcaatggcgggcgcccctcccccagcctcgctgccaccttgcagtttgatctcagactgctgtgctagcagtcagtgagactccgtgggtgtaggaccctccgagccaggtgcgggatataatctcgtggtgcaccgttttttaagcccatcggaaaagcgcagtattagggtgagattgacccgattttccaggtgccatctgtcacccctttctttgactaggaaagggaactccctgaccccttgcgcttcccgagtgaggcaatgcctcgccctgcttcggctcccgcacggtgcgctgcacccactgtcctgcacccactgtctggcactccctagtgagatgaacccagtacctcagatggaaatgcagaaatcacccgtcttctgcattgcttactctgggagctgtagaccggagctgttcctattcggccatcttggctgccagcttctttgtgtagtttcattaccacttgagatgcaattaaatttgttttagttttcagtttgagggaatttgtttttctttttagttcaactttagtttttgagtatgtataattttaagcagcattaatagagtataatcttttcaacactgcccaaaacatgacacatctagaataatctgtttacttctttttgccatattttaggaatggccagcccagtatcaagggtgggatgatacg

SEQ ID NO: 12697 - DNA, 9780 bp, Homo sapiens
ccaggctggagtgcagtggcgcgatctcggctcactgcaagctccacctcccgggttcacaccattctcctgcctcagcctaccaagtagctgggactacaggcgcctgccaccatgcccggctaattttttttgtatttttttttttttagtagagacggggtttcaccgtgttagccaggatgatcttgatttcctgacctcgtgatccgcccacctcggcctcccaaagtgctgggattacaggcgtgagccaccgtgcccggccgaggttttttctctgagctttttactctgaagatgaagcccagctgtaaattatattatttttgtttctgagacacagtctcactgtgtctcccaggccagagtggtcatggtaggatggtaggtcatggtagaacagaaggagcatggaccatgtgaacctggacttgaacactggctccacaatttagcagccacgtatctctgagggagctaatcagcctcccagagcctttatttcctcaattataaaatgaagataataacaatctaagaaggttatgggtggttactaaaaaatgttagttttaaaaacagtagagcggggtgttcacagcacttgggaggtggctcacacctgtaatccccacactttggaaggccaggatgggaagattgcttgggcccgggaattcaaaaccagcctgggcaacatagagagaccctctctctacaaagaaattaaagaaaaaaaaattagccgtgtgcagtggcatacacttgttgtcccagctactcaggaggctgaggtagacggatcacttcagcacaggaggtcaagaccacagtgagccatgatcgtgccactgcactccagcctgggtgacagagcaagaccctgtctcaaaaacaaaaaacaaaacaaaacaaaaacacaaaaaaaagaacagtagtaataacctgcattgcaactgattacctatcacgctagcatatagggaacataattataactgcttaaaattagttgagcaagccaggctcagtggcatgcgcctggaatcccaaccacttgggaggctcaggcagaaggaccccttgagcttagacattcaaagtgtagccaggtgcagcggctcatgcctgtaatcccagcactttgggagactgaggagggtggatcacttgagatcaggagatcgagaccagcctgaccaacttggtgaaaccccatctctactaaaaatacaaaaattagccaggcatgttggcacacgcctgtaatcccagctactcgggaggctgaggcacgagaatcgcttgaacccgggaggcagaggttgcagtgagctgagattgcaccactgcactccagcctgggcaacagagtgagacccctcctgtaagcaataaaatacaatttgagaatgtataaccaaatcactctgatatccagtaatctccctattgctttaggaaccttaatatttaatgacttgaaagtaatcttttatcaagcagtgttccagtcaatgaaatgtaatttataatactgtactgtatgactagacttcagtaaaaattacttaattactgaagtctttagccatttttcttactttcaaggtctcagccagaaaactgaaaccaactccaccacggccacggagcctccatgaaagaatattagaagaaattaaagcagaaagaaagctgcggcctgtatcaccagaggagattagacgtagcagattaggtgagtccactgcttcctgtactcagtctagagtcatcccctgggaaaaggatctttatacacccagccccatgaaagtaaagagttctcattccttgttcatttctctgtatctcactcacttgttctccctctcactctctcgtatacataccccctctcactctctcatatacataccccctcacacttacttgaaatttatagggtgggaaatccttccgcctatctaatactgaactatatgagaacatcgtgccgtaattgaaagagctctgccagtctctaggctgaggttttaggaaagtctctttacctctctgagcatcattttcttcattggcagaagggggataaaaattcctcttaacctacattatgagttttatgtaagaattaaataggattatggtaaaaaaatactttataaattgtattgcatatacaaagataacgtattatattttaaaaatatagatgatagatgtacagttttaccttatgtttgtttattatgggtttaaagatacccgtaatattatgtcatgaaagcatgttattaccggatattacttaacttatttctaaacttcctttacagttattattttttattttttagtgtatactacaagcacatattgattttgatttataggaaggccatattataagatgtctgtaaacatttttatttatacgactgtctttcagtttgtaagactaaaaatgcccaaagaatccagagaaactgcctttacgaaaacggtctatagtggtaccttaacaggaaaggatctggttttgtgacccccactctgctagttttctcctctgatctcttcttctgcctttttcagactcttggacttcaaagtttctatcctggcttctgttctccctaagcaaccataccctcttccatggtttttgtttctgactaccttccagctcacagtctacattgcagatctgtaaaaatgcagactcatacgtccagctgtctgctagatagagccttatcatatcctacaagcaagacaaacccaatatttccacaagtgaactcatcctgtctctccccaaaccattgcattttgttttcccaatgtagaaaccttaacataatctttgactcttacccgatggccaacccctgttgattttacttcctctggatctttttaatcttctactcttctcagcccagcagccactatcccagccgaggctgtcatctgtcgcagcagcactgattgtcctcctgcttccagtcttgaattcttccaccattccatattgattttccttgtttaatcctgacccttctgttgtgtgaccttcgtgatgacagggcccatgtctgtcttgttcgttgttgtgtccctagtacagcactgggctgtacagagtactctcatgggttgaaataattaaatgtactttctggtgacaaagcttcagagtggatcacttgagcccaggagatcaaggctgtagtgagctgtgattgcaccactccactctagcctgggtgaaccaagattccatggaaagaaagaaagaaaaaaaaaagatcagttgactgtatatgtgtgggttcatttctggactctttgttctgttccactgttgtttgccagtaccatgctgtttttgttattgtaactttataatatattgtaagatcagaaagtgtgatgtctctggctttgttattctttctcaagattgattggctattcattgtcttttgtggttccataggaattttaggattatcttctacttctgtaaaaaataccattaggattttcttttttttttttttttttaaattaaacagttttttgggggtgtaaccagcatacaataagttcacatattaaacgtacacaaattggaagagttttgacacatgcaaacagccatgaaaccatcataacaattaaaataacaaacatttccatgttggcttggtatggtttttttttttttttcccatggtgttttttttttattatactctaagttttagggtacatgtgcacattgtgcaggttagttacatatgtatacatgtgccatgcttgtgcgctgcacccactaatgtgtcatctagcattaggtatatttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaaccggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcattgtgaatgggagttcacccatgatttggctctctgtttgtctgttgttggtgtgtaagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtgactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttgtcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccatttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgacccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccag

SEQ ID NO: 12698 - DNA, 6071 bp, Homo sapiens
cttcttcttttttttttaaagtatttcttttttttttttaattttttttttattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaagagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgttttcttcttgtaaatttgtttgagttcattatagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctagcgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaaggtaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatattcatcaaggatattggtctaaaattctcttttttggttgggtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaaggtttttttgtgtctctatctccttcagttctgctctgattttagttatttcttgccttctgctagcttttgaatgtgtttgctcttgcttttctggttcttttaattgtgatgttagggtgtcaattttggatctttcctgctttctcttgtgggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagcctctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactttttatccaacttgccagtctgtgtcttttaattgcagaatttactccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttcacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccacatcacttttaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggcttctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtgattttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggtgccaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccgggctgctttgtttacctaagcaagcctgggcaatggcgggcgcccttcccccagcctcgctgccgccttgcagtttgatctcagactgctgtgctagcaatcagcgagattccgtgggcgtaggaccctctgagccaggtgtgggatatagtctagtggtgcaccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgtgcacggtgcgcgcacacactggcctgcgcccactgtctggcactccctagtgagatgaacccggtacctcagatggaaatgcagaaatcacccgtcttctgcgtcgctcacgctgggagctgtagacaggagctgttcctattcggccatcttggctcctccccta

SEQ ID NO: 12699 - DNA, 21577 bp, Homo sapiens
tatccctcctccctccccccaccccatgacaggcacctttatgtgatgttccccaccctgtgtccaagtgttctcattgttcaatactcacctatcagtgagaacatgtggtgtttggttttctgtccttgggatagtttgatcagaatgatggtttccagcttcacccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatggcagcatgatttataatcctttggttatatacccagtaatcggatggctgggtcaaatggtatttctagctctagatccttgaggaattgctacactgtcatccacaatggtggaactagtttacagtcccaccaacagtgtaaaagtgttcctatttctccacatcctctccagcacctgttgtttcctgactttttaatgattgccattctaactggtgtgagatggtatctcattgtggttttgatttgcatttctcagatggacagtgatgctgagcattttttcatgggtctgttggctgcataaatgtcttcttttgagaagtgtctgttcatatcctttgcccactttttgacggggttgtttgattttttcttgtaaatttgtttaagttctttgtagattctggtaattagccctttgtcagatgggtagattgcaaaaattttctcccattctgtaggttgcctgttcactctgatggtactttcttttgctctgcagaggcccttagtttaattagatcccattttgtcaattttggcttttgttgccattgcttttggtgttttaatcatgaagtccttgcccatgtctatgtcctgaatggtactgcctaggttttcttctagggtttttatggttttacatataacatttaagtctttaatccatcttgaattaatttttctataaagtgtaaggaagggattcagtttcacctttctacatatggctagccagttttcccagcaccatttattaaatagggaatcctttccccatttcttgtttttgtcaggtttgtcaaagatcagatggttgtaaatgtgtggtgttatttctgaggcctctgttctgttccattgatctacatctctgttttggtaccagtaccatgctgttttggttactgtagccttgtagtatagtttgaagtcaggtagcatgatgcctccagctttgttcttttggcttagtgttgtcttggcaatgcaggctcttttttggttccatatgaattttaaagtagtttttcccaattctgtgtagaaagtcactggtagcttgatggggatggcactgaatctataaattaccttgggcaatatggccatttttgcgatattgattcttcctatccatgagcatggaatgttcttccatttgtttgtgtcctcttttattttgttgagcagtggtttgtagttttccttgaagagttccttcacatcccttgtaaactggattcctaggtattttattctctttgaagcaattgtgaatgggagatcactcataatttggctctctgtttgtctgttattggtgtataggactgcttgtgatttttgcacattgattttgtatcctgagactttgctgaagttgcttctcagcttaaggagattttgggctgagacgacggggttttctaaatgtacaatcatgtcatctgcaaacagggaaaatttgacttcctcttttcctaatcgaatacactttatttctttctcttgcctgattgccctggccagaacttccaacactatgttgaataggagtggtgagagagggcattcctgtcttgtgccagttttcaaagggaatgcttccagtttttgcccattcagtatgatattggctgtgggtttgtcataaatagctcttattattttgacatatgtcccatcaatacctagtttattgagagtttttagcatgaagggctgttgaattttgtcgaaggccttttctgcatctattgagataatcatgtggtttttgtctttggttctgtttatatgatggattatgtttattgatttctgtatgttgaaccagccttgcatcccagggatgaagccaacttgatcgtggtggataagctttttgatgtgctgctggatttggtttgccagtattttattgaggatttttgcatcaatattcaacagggatattggtctaaaattctccttttttttgttgtgtctctgccagtctttggtatcaggatgatgttggcctcataaaatgaattagggaggattccctctttttctattgattgggattgtttcagaagaaatggtaccagctcctctttgtacctctggtagaatttggctgtgaatttgtctagtcctggactttttttggttcgtaggctattaattattgcctcaatttcagaacctgttattgatctattcagggattcaacttctttccagtttagtcttgggagggtgtatgtgtccaggaatttatccatttcttctagattttctagtttatctgcatagaggtgtttatagtattctctgatggtagtttgtatttctgtgggatcggtggtgttatcctctttttcattttttattgcatctgtttgattcttctctcttttcttctttattagtcttgctagtggtctatcaattttgttgatcttttcaaaaacccagctcttggattcatttattttttgaagggtttttttgtgtctctatctccttcagttctgctctgatcttagttatttcttgccttctgctagcttttgaatgtgtttgctcttgcttctctagtacttttaattgtgatgttagggtgtcaattttaaatctttcctgctttctcttgtgggcatttagtgctataaatttccctctacacactgctttaaatgtgtcccagagattctggtatgttgtttctttgttctcattggtttcaaagaacatctttatttctgccttcatttcgttatgtacccagtagtcattcaggagcaggttgttcattttccatgtagttgaatggtattgagtgagtttcttaatcctgagttctagtttgattgcactgtggtctgagagacagtttattataatttctgttcttttacatttgctgaagagggctttacttccaactatgtggtcaattttggaataagtgtgatgtggtgctgagaagaatgcatattctgttgatttggggtggagagttctgtggatgtctattgggtctgcttggtccagagctgagttcaattcctggatatccttgttaacttcctgtctcgttgatctgtctaatgttgacagtggggtgttaaagtttcccattattattgtgtgggagtctaaatctctttttaggtctctaaggacttgctttatgaatctgggtgctcctatattgggtgcatatatatttaggatagttacctcttcttgttgaactgatccctttaccattatgtaatggccttctttgtctcttttgatctttgttggtttaaagtctgttttatcagagactaggattgcaacacctccttttttttgttttccatttgcttggtagatcttcctccatccctttattttgagcctatgtgtgtctctgcatgtgagatgggtctcctgaatacagcacactgatggttcttgactctttatcccatttgccagtctgtgtcttttaattggagcatttagtccatttacatttaaggttaatattgttatgtgtgaatttgatcctgtcattatgatgttagctggttattttgctcagtagttgatgcagtttctgcatagcgtcgatggtctttacaattggacatgtttttgcagttgctggtactggttgttcctttccatgtttagtgcttcttcaggagctcttgtaaggcaggcctggtgctgacaaaatctctcagcatttgtttgtctgtaaaggatttcacttctccttcacttatgaagcttagtttggctggatatgaaattctgggttgaaaattcttgtctttaagtatgttgaatattggcctccactctcttctggcttgtagagtttctgccaagagatctgctgtttgtctgatgggcttccctttgcaggtaacccaacctttctctctgcctgcccttaacattttttccttaatttcaactttggtgaatctaactattatgtgtcttggagttgctcttttcgaggagtatctttgtggtgttctctgtatttcctgaatttgaatgttggcctgccatgctaggttggggaagtttttctggataatatcctgaagagtgttttctggcttggttccattctccctgtcactttcaggtacaccaataagatgtagatttggtcttttcacatagtcccatatttcttggaggctttgttcatttctttttactcttttttctctaaacttctcttctcgcttcatttcattcatttgatattcaatcactgataccctttcttccacttgatcaaatcggctactgtagcttgtgcacgtatcacgtagttctcgtggatggtttgcagctccatcaggtcatttaaggacttctctacactctttattctagttagccattcatctaatcttttttcaaggatttttgcttctttgtgatgggttcaaacatcctcctttagctcagagaagttgttattaccgattgtctgaagccttcttctctcaactcgtcaaagtcattctccatccagcctttttccattgctggcgaggagctgcattccttcggaggggaataggcactctgatatttagaattttcagcttctctgctctggtttctccccatctttgtggttttatctacctctggtctttgatgatggtgatgtacagatggggttttgatgtggatgtcatttctgtttattagttttccttctaacaatcaggaccctcagctgctggtctgttggagtttgctggaggtccactccagaccctgtttgcctgggtatcaccagcagaggctgcagaacagcaaatgttgctgtctgatccttcctctggaagcttcatctcagaggggcacccagctgtatgaggtgtcagtcagcccctactggaaggtgtctcccagttaggctactcaggggtcagggacccacttgaggaggcagtctgtccactctcagatttcaaactccatgctgggagaaccactactctcttcaaagctgtcagacagggacgtttaagtctgcagaagtttctgctgccttttgttctgctatgccctgcccccagaggtggagtctgcagaggcatgtaggcctccttgagctgccatgggctctacccagttcgagcttcctggtggctttgtttacctactcaagcctcagcaatggcagatgcccctccctcagcctcgctactgccttgcagttcaatctcagactgctgtgctagcagtgagcgaggctccatgggtgtgggaccctccaagccaggcacagaatataatctcctgtgtgccatttgctaaggccgttggaaaagtgcagtattagggtgggagtgtcccgattttccaggtactgtctgtcacggcttccctttgctaggaaagggaattccccgacgctttgtgcttcctgggtgaggcaatgccccaccctgctccatgagctgtgcccactgtcagacaagccccagtgagatgaacccagtacctcagttggaaatgcagatacctcagttggaaatgcagaaatcacccatcttctgtgtcactcaggctgggagctgcagactggagctcttcctatttggccatcttggaacctccaccagtagttctatttttaattttttgaggaacttccattctgttttttataatgactgtagtaattttcattctcaccagtagtgtataagagttttccttgctccacatctatgtcagcattcattactttttgtctttttgatagtagccattctaattgaggtgaaatgatatttcattgtggtttttatttgcatttccctgatggttagtgatgctgagcattattttcagaaacctgttagccactcacatatttccttttgaggaatgtctattcaggtcttttgctcaaggaaagagaacaagagtctctgcctggtaatccagataattattctggatcttgtctaaggccatgaaggtaacaccactatgagtctgcaagaactagtgttagtgggctttgtgtgcccccctaaagcagatacaccttacagcacaatgcccaagtcctttcaaatacctggaaagccttcccaagaaagacaggtacaaacaagcccagaatgtgaagactataataaatacataactcttcaatgcccagatacggatgaacatctgcaagtatcaagacaatccaggaaaaacatgaccttaccaaatgaactaaatagggcaccagggacaaagcctggagaaacagagctatgtgacctttcagatatagaattcaaaatagctattttgagaaaactcaaagaaattgaagataacacagagaataaattcaaaattctatcagattaatttaacacagagattcaaataattaaagagattcaagcagaaattctggagttgcaaaatgcaaccggtatattaaagaatgcatcagagccttttaacagcaagattgattaagcagaagaaagcactagtgagcataaagacgggctatttgaaaatacacagaggagacaaaaggaaaaagaataaaaaacaatgaagcacacctacaggatctagaaaatagcttcaaaggggcaaatctaagccttcttggccttaaagaaaaggtagagtaagagatgggggcagaaagtttattcaaagggataataatagagaatatcccaaatctagacaaaaatgtcaatatccaagtacaagaaggttatagaacaccaagcagatttaacccacagaagaccacctcaaggtgtttaataatcaaacccccaaagatcaaggataaacaaaggatcctgaaggcagcaagaggaaagaaacaaatcacatacaatggagcaccattcacatacatctggcagcagactcttcagtggaacccttacaggccaagagaagtttgcatgctatgtttaaagggctgcaggaaaaaaaacttttacactagaatagtatatctgacaaaaatgtctttcaaatataaaggaggaataaagactttccctaacaaacaaaagctgatgaatttcatcaaccccagatatgtcctacaaaaaatgctaaagggagtacttcaattagaatgaaaaggatattaatgaacaataagaaataatctgaaggtacaaaactcagtggcaatagtaagtacacagaaaaacacagaatattataacactgtaactgtggtatgtaaactactcccatatttgcagaagcactaaatgatgaaccaaagaaataactacaacttttcaatacataggtagtacaataagatataactagaaacaacaaaaagttttaaaatggaggggtgtggaaacaatgttaaggtgtgaagtttttattagttttctttttgtttgttgtttatgtaaacagtgttaagttattatcagcttaaaataattgttataagatagtatttgcaagcctcatggtaacctcaaaccaaataacatagaactgatatgcagacacacacacacaaagcaagaaactaagttgtatcaccagacaaaattaccttcactaaaaggaagacagaaaggaaagaaagaagagaaaaccacaaaacaaccagacaacaaataacaaaatggcaagagtaagtccttacttaccaacaacattgaatgtcaatggactaaactcttcaatcaaaagacatagaatggctgaatggataaaaaaaaaaaaagacccagtaatctgttgcctacaagaaacacaggtaagctataaagacagatatagactaaaaataaggggatggaagaatatatcccatgccaatggaaaccaaaaaagagcaggaacagctatacttttgtcagacaaaatagatttcaagacaaaaactaagagacaaagaaggtcactatataatggtaaaggggtcaattcagtaagaggataaaataattttaaatatatttgcactgagcactggagcacctagaaatataatacaaatattattagagttaaagtgagagataaaccccaatataataataactggagacttcaacaccctgctttcaacactgaacagatcttccagacagaaaatcaacaaagacacatcagacttcaactacactatacaccaaatagacctaatagttatctacagaacatttaatccaacagctgaagaatacacatacttttcctctgcacatggatcattttcaaggaaagactatatgttaggtcacaaaacaggtcttaaaacattcaaaaaattgaaattatatcaagcatcttctcttaccacaatggaataaaactagaaatcaataatgagagaaactttggaaactataaaaacacatggaaattaaacaagatgctcctgaatgaccagtgggtcaataaagaaattaggaaggaaattgaaaattttcttgaaacaaatgattaagaaaatacaacatgccaaaatctacgggattcagcaaaaacagtactaagagggacgtttatagctctaagtgtctatatcaaaaaacaagaaaaacttcaaataaacaacctaatgatgcatttcaaggaactagaaaagcaagagcaaaccaaacccaaaattggtagaagaaaagaagtaataaataccagagcagaaataaatgaaattgaaatgaagaaaacaatataaaatttcagtgaaacaaagagttgggtttttgaaaagttaaacaaaattaacaaatctttagccagactacctaagagaaaacgagagaagctccaagtaaatacaatgagaaatgaaaaagagacattacaactgaggtgctgcagaaattcaaaggatcattagtggcttatatgagcaactatataccaataaattagaaaatctagaagaaattgataaatacctagacacatacaacctagcatgattgaaccaggaagaaatccaaaatctgaacagattaataacaagtaacatgatttaagttgtaataaaatgtctccccataagaagaacccaggactcaatgacttcactgctgaatcctaacaaacatttaaagaagaaggaataccagttgtactcaaattattctggaaaatagtggaggagggagtatgtccaaactcatcctaccaggtcagtgttactctgataccaaaactggacaaagacacatcaacaaagcaaactacagccaatatctctgatgaatattgatttaaaaatcctcaacaaaatgctagcaaatagaattcaacaatacatcaaaaagatcattcatcatgaccaagtgggatatctccctggaatgcaaggaggattcaacatatgcaaattaatcaatgtaatatatcatatcaatagaatggagaaaaaaaccatatgatcatttcaaatgatgctgaaaaagcatttgataaaattcaacatcccttcttgataaaaacactgaaaaaactgggtatagaaggaaaatacatcaacataataaaagccatgtatgacagacccacaactaatatcatatggaatgggaaaaaattgaaagccttttatctaagatctgaaacacaacaaggatgcttacttttaccactattatttaacataatgctggaagtcctagctagagcaatcagacaagagaaagaaataaagtccatccaaattggaaaggaaaaagcaaaattatcctttttgcagacaatattatctcatatttggaaaaacctaaagacttcaccaaaaattaaatgcctaggaattaatttaaccaaagaagcaaaagagctctataatgaaaactataaagcaccgatgaaagaaatggaaggggacatcaaaaaatgaaaaatattctatgttcaggatcagaagaatcaatattgttaaactgtccatactaccaaaagcaatctacagatccaatgcaatacctatcaaaataccaatgacattcttctcagaaatagaaaaaacaatcctaaaatttatatgaaaccacaaaagacccagaatagccaaagctattctaaggaaaaagaacaaaactggaggaatcacattacctgacttaaattatattacagagctatagtaatcaaaactgcagagtactgccatagaaatagacatgtagaccaacagaacagaatagagaacccagaaacataacataacccacataactacagcgactcattttttataaaggagctaagatcatacaatgaggaaaaggcattattcaataaatggtgctgcaaaaacttgatatccatatacggaagaatgaaactagaccccaatctctcatcatatacaaaaaggaaacaaaatggattaaaaattaaatctataaactcaagctatgaaatgactacatggaaacattggagaaattctttggaacattggtctgtgcaaaaatatctgagagtaatactccacaagcacaggcaaccaaagcaaacatgtacaaatggtatcacatcaagttaagaggcttcttcacagccatggatacaattgacaaagtgaagagacaactcacagaatgggagaaaatatttgctaactacccatctgacaagggattaataatcagaatacataaggagtgcaaataactctataggaaacatctaataattcaatgaaaaaatgggcaaaagatttgaatagatgtttctcaaaagaagatgtacaaatggtgaacatacaaatgaaaaggtgcacaacatcattgatcatcagagaattgcaaatcaaagctacaatgagatattatctcaccccagttaaaatggcttatgtccaaaagagaggcaataacaaatgctggtgaggatgcgaagaaaagacaatccttacacactgttgatggtaatgtaaatttgtacaaccactatggagaagagtttagagattcctcaaaaaaatgaaaaattgctctaacatatgatccttttttggggtattgaatatacccaaaagaaaggaaatcagtatgttgaagagatatctgcactcctatgtttgtttcagcactgttcacaatagccaaaatttggaagcaacctaagtgtccatcaacagatggatggataaagaaaatgtacttatacataatggagaactattcagccatgaaaagaataatatcttgtcatctgcaataacatggatggaactgggggtcattatgttaaatgaaacaagccaggcacagaaagacaaacattgcatgttctcatttatttgtgggatctagacatcaaaacaattaaactaatgaagatagagtagaagaatggttaccagaggcttggaagggtattgtagcctggtagggaggtggggattgttaatgagtgtgactaaaagagttagttctttgaaaataattggacaaacagctaaactaagaaaaaacagagaagattcaaataaataaaatcagaaataaaaggagagacattacgactgataccacagaaataaaaatgattgtaagagactactatgaacaatcatatgctaacatacaatatagcaagactaagtcatgacgaaatcaaaacatcagaacaggaatagttaactcctatgactagtaaggagttatgaatcagtaacaaaaaacctaccaaaaaaaatactcacaaccagataacttcactggaaagatctaccaaacatttaaagaagaattaattccaatctttctcaaactcttccaaaaaataggagaagagagaacacttctaaacccgttttatgagtcaaacgttactcagatactgaagtcaggaaaagacactaaagaaaagaaaactacagagcaatgtctctgatgaatattgatgccaaaatttctaacaaattaaattcaagaggacaataaatgaattatacactatgaccaaatggcatttacttccaataaaaggataactcaacatataaaatttgaacaatattatacatcacagtatcagaatgaaggacaaaaaccacattatcatctcaactgatgcagaaaaatcatctgacaaaaatccaacactctttcatgataaaaacactcaacaaactataaatagaagaaaactacctcacataataaaggccatatatgaaaagtctgcaactaacatcatagtcaatgatgaaagaaattggaagtctcatgtagcattactgggaatgtaaaatggtacaaccattatggaaaacagtatgtaagaccctcaaaaaattataaattgaattaccatatgatccagcaattgcacttctaggtatatatccaaaagagttgacagcaggatcagtaagagctatttgcacaccgatgttcactgtagcattattcacaatagccatgaggcagaagcaaccaagatgttcatatatggattaatgattaaacaaaatgtggtatatacatacattagaatattattcagccttaaaaatcctgttacatactatacatgtgctatatgaatgaaacttgaggacattatactaagtgaaatgaggcagtcaccaaaagacaaatactgtatgatttcactttaataaattgtctaaactggtcgatctcatagaaacagaaagtaaaatggtgttttccagggattggagagagggagaaatgggaagatgttatccaatgtgtacagagtttcagacttgcaagatgaaaaagttctagagattttgtaaaacatgtatatagttaatgcaattgaactgcacacttaaacacgattcagatgataaattttgttctgggtttttagcacaatttttaaaaggtctctatgatgttacctttttgtacagagtgttgagttttgttttgttttgttttgtcttttctggcaggcagttaacttactagtggctctaattgatcctattgaagcttggttttagtcctttaagaatatgtctagagcaacatttgctctagggcaagaataggcttactccttagataatggtttttgacatctcaactaaatacccagtgttcgatgtattcagcaaggtccctctactctgacttattggacctctactatctctcagcactattcaacctctaatatctctttttttatttttattttttattttattttattattattatactttaagttttagggtacatgtgcacaatgtgcaggttagtttcatatgtatacatgtgccatgctggtgtgctgcacccattaactcgtcatttagcattaggtatatctcctaaagctatccctccccctggccccaccctgcaacagtccccagagtgtgatgttccccttcctgtgtccatgtgttctcattgttcagttcccacctatgagtgagaatatgcggtgtttggtttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttatagcagcatgatttatagtcctttgggtatatacccagtaatgggatggctgggtcaaatggtatttctatttctagatccctgaggaatcaccacactgacttccacaagggttgaactagtttacagtcccaccaacactgtaaaagtgttcctgtttctccacatcctctccagcacctgttgtttcctgactttttaatgattgccattctaactggtgtgagatggtatctcattgtggttttgatttgcatttctctgatggccagtgatggtgagcattttttcgtgtcttttttggctgcataaatgtcttcttttgagaagtgtctgttcatatccttcgcccactttttgatgcggttgtttgtttttttcttgtaaatttgtttgagttcattgtagattctggatattagccctttgtcagatgagtaggttgcgaaaattttctcccattttgtaggttgcctgttcactctgatggtagtttcttttactgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtcgaacgtttaagtctttaatccatcttgaattaatttttctataaggtgtaaggaagggatccagtttcagctttctacctatggcaagccagttttcccagcaccatttattaactagggaatcctttccccattgcttgtttctctcaggtttgtcaaagatcagatagttgtagatatgcggtgttatttctgagggctctgttctgttccattgatctatatatctgttttggtaccagtaccatgctgttttggttactgtagccttgtagtatagtttgaaatcaggtagcatgatgcctccagctttgttcttttggcttaggattgacttggtggtgtgggctcttttttggttccatatgaactttaaagtagttttttccaattctgtgtagaaagtcattggtagcttgatggggatggcattgaatctataaattaccttgggcagtatggccattttcacaatattgattcttcctacccatgagcatggaatgttcttccatttctttgtatcctcttttatttcattgagcagtggtttgtagttctccttgaagaggtccttcacatcccttgtaagttggagtcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacattggggctttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatacatagctcttattattctgagatacgttccatcaatacctaatttattgagagtttttagcatgaagcattgttgaattttgtcaaaggccttttctgcgtctattgagataatcatgtggtttttgtcttttgttctgtttatatgctggattacatttattgatttgtgtatattgaaccagccttgcatcacagggatgaagcccacttgatcatggtggataagccttttgatgtgctgctggatttggtttgccagtattttactgagtatttttgcatcagtgttcatcaaggatattggtctaaaattctcttttttggttttgtctctgcctagctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagttattgattattgccacaatttcagatcctgtgattcagatcctgtgattcagatcctgtgtattcagagagtcaacttcttcctggtttagtcttgggagggtgtatgtgtccaggaatttatccatttcttctagattttctagtttatttgtgtagaggtgtttgtagtattctctgatggtagtttgtatttctgtgggatcggtggtgatatcccctttatcattttttattgcatctatttgattcttctctcttttcttctttattagtcttgctagtggtctatcaattttgttgatcctttcataaaaccagctcctggattcattaattttttgaagggttttttgtgtctctatttccttcagttctgctctgatcttagttatttcttgccttctgctagcttttgaatgtgtttgctcttgcttttctgtgtcttttaattgtgatgttagggtgtcaattttaaatctttcctgctttctcttgtgggcatttagtgctataaatttccctctacacactgctttgaatgtgtcccagagattctggtgtgttgtgtctttgttttcgttggtttcaaagaacatctttatttctgccttcatttcattatgtacccagtagtcattcaggagcaggttgttcattttccacgtagttgagtggttttgagtgagtttcttaatcctgagttctagtttgattgcactgtggtctgagagacagtttgttataatttctgatcttttacatttgctgaagagagctttacttccaactatgtggtcaattttggaataggtgtggtgtggtgctgaaaaaaatgtatattctgttgatttgggttggagagttctgtagatatctattaggtccgcttggtgcagagctgggttcaattcctgggtatccttgttaactttctgtctcgttgatctgtctaatgttgacagtggggtgttaaagtctcccattattattgtgtggcagtctaagtctctttctaggtcactcaggacttgctttatgaatctgggtgctcctgtattgggtgcatatatacttaggatagttagctcttcttgttgaattgatccctttaccattatgtaatggccttctttgtctcttttgatgtttgttggtttaaagtctgttttatcagagactgggattgcaacccctgcctttttttgttttccatttgcttggtagattttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggctattttgctcgttagttgatgccgtttcttcctagcctcgatggtctttacaatttggcatgattttgcagtggctgccaccggttgttcctttccatgtttagtgcttccttcgggagctcttttagggcaggcctggtggtgacaaaatctctcagcatttgcttgtctgtaaagtattttatttctccttcacttatgaagcttagtttggctggatatgaaattctgggttgaaaattcctttctttaagaatgttgaatattggcccccactctcttctggcttgtagagtttctgccgagagatccgctgttagtctgatgggcttccctttgtgggtaacccgaccttcatctctggcctcccttaacattttttccttcatttcaacttttgtgaatctgacaattatgtgtcttgagttgctctttttgaggagtatctttgtggcgttctgtatttcctgcatctgaacgttggcctgccttgctagattggggaagttctcctggataatatcctgcagagtgttttccaacttggttccattctccccatcactttcaggtacaccaatcagacgtagatttggtcttttcacatagtctcatatttcttggaggctttgttcgtttctttttattctgttttctctaaacttcccttctcgcttcatttcattcacttcatcttccatcactgataccctttcttccagttgatcgcatcagctcctgaggcttctgcattcttcacgtagttctcgagccttggctttcagctccatcagctcctttacgtacttctctgtattagttattctagttatacattcgtcaaaatcattttcaaagttttcaacttctttgcctttggtttgaatttcctcctgtagctcagagtagtttgatcgtctgaagccttcttctctcaactcgtcaaagtcattctctgtccagctgtgttccgttgctggtgaggagctgcgttcctttggaggaggagaggtgctctgctttttagagtttccagtttttctgctgtgttttttccccatctttgcggttttatctacttttggtctttgatgatggtgatgtacagatgggtttttggggtggatgtcctttctgtttgttagttttccttctaacagacaggaccctcagctgcaggtctgttggagtttgctagaggtccactccagaccttgtttgcctgggtaccagcagcggtggctgcagaacagtggatttttgtgaaccgcaaatgctgctgtctgatcgttcctctggaatttttgtctcagaggagtacccggccgtgtgaggtgtcagtctgcccctactggggggtgcctcccagttaggctgctcgggggtcaggggtcagggacccacttgaggaggcagtctgccctttctcagatctccagctgcgtgctgggagaatcactgctctcttcaaagctcagatggaaatgcagcctctaatatctctatttggctcacaaccctcaagtagttctcttcagggtttcagcaaatcttgccctataaatgcctaatattaagccagtggcttaaggtgaccttagaaaagatttctgaagcttcatctctaaacagctacctcctctctactaacctgcttcataaatcccagccacaatgctaataatgtctaccttagacaccatcaatttctctttgggttctatttcactgcgttcctaatcaaaaagccagggtaaatgtgttgcttacctccagtagttctttcttttccaggatagcagtgttgtggagtctgttgttagatgtctaaaaagagttgctgcttatgtattttttgagtgttatatttgtttatggctgaagggtaaatctaatagttataaccctgtcattattcagatgaagaatttgtcattttaagtttctcttttttatattcaccacctaccattctacagtattttttgattctttgtgggatttttctctgtctctacaataacttaacttccatgagaagtgattctgtcagtcttactcaattcagatctctagtgctcagaagagtgcttggtactcatgaataaacaacaaatatttaataaaattaaatgaaatgaatgagtaaattattgaataattatgcacagatgaaatttgcttcagaacatattaaaaattttacactagcaatataaaagaataggtgaatagatgttgaaaaaatttgtgcaaaacctatgatattgaagaagaaaataaggggcagacaaagaagtgaaggaataaaaaatgaagaagaaataagaagacagtaaaagaggaaaatggaaaagaagaaagtttgtagaattgtggagaaaaaaagacaaaaagacaagagaagaaatgaggatatttttgtaaaaaggaaaggaagaaaaagaaaagaggcaagtattattttaattctctaacacagcaaacatactgtgccctgactttgtattttaaggcaaaattctagggctgcaatggtgaaaatagttgggttattctttctaaacacctttatccccaaacatatttgccctgatgtgtaagaaatacacacaaaaatataatccaacttagattatgagtgccataggaaagtgctgtgagaagagtgatatcaaaaccttatatggggatctagctaggtaggcatcttagagaaagtgactaagtttgaaggatgaatagaaattaaacagatgttatgggaggaaacaatttgacaaaaggtttggaataaggaaaagaaagagcatggaacagaaattgtaaaagtttctgattggctttcctaataatgtctgaatgacgctgttgggaatgtgtattgggaatgcaagtttaagtctcacatggagagtctcgaatattgtgctaggagtttgaacttttaagtgctctttagcttttggaaacctctgagagtttttcaataagaaagtaataagctcagatcagtgattttagaacataaaatgtaattttaaaaagcagagaaataaatagaaaagagagagaaggcaactttgagcaaaacttttttcttaaaaaaagcgtttttggcacttagttctagaaatgatagaaaaacagatggaaaagatgttggtactggaaattattttatcagtctgtttttatcctgcttgctaagaaagggcatgacttttttattatgcatctaaggatctcttttactttgagccattttcacttggacacattatagttgagtgctgatattactgatgtgcttcctcccctaaatccccttgcccaacaggggttaagttcttgtaggcctaagtgtctgaaaactctgctcctctaacgtgaaaaatcaaacaaaaacaaatgaaacaccaccagttatcaggaatcagcgtttctctgcaacaaaagaaaatagaggatcatgttcacccactctgctttatttatgggaattaaattgggtttggtgtacagaatatctctatctcaataaaattcaagtgctgcgcagaagataaacggaatatacttttaaatgaaattgcttttcgttttggcagcagggtatttggtcattcaggaacttttgcacctctcacttttcacagaaggtcttttagagatgtatttcagctaaggagctcacctctatgaaaggaggactgggcccctagggttagctcttaaagattacttctaagtcatttcaagcattctgaatatttttcagttatgttcattcagactgatttgatatccatgggcaatattattttgaggtaacacttcataagtattaaaaaaaattactgtcccccccatttgaactatttaaaaagagagttaatggaatgtagagttacttaatttatgataaaattcatacc

SEQ ID NO: 12700 - DNA, 6078 bp, Homo sapiens
tttcttttttttaatctgataactaaatttatttatttatttttattttttatttattttttattaaagttttagggtacatgtgcacattgtgtaggttagttacatatgtatacatgtgccatgctggtgcgctgcacccaccaactcgtcatctagcattaggtatatctcccaatgctatccctcccccctccccccaccctacaacagtccccagagtgtgatattccccttcctgtgtccatgtgatctcattgttcaattcccacctatgagtgagaatatgcagtgtttggttttttgttcttgcgatagtttactgagaatgatgacttccaatttcatccatgtccctacaaaggacatgaactcatccattttcatggctgcatagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccccatcctctccagcacctgttgtttcctgactttttaatgattgccattctaactagtgtgagatagtatctcattgtggttttgatttgcatttctctgatggccagtgatgatgagcattttttcaggtgtctgttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccaattgtcaattttgtcttttgttgccattgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaaggcattggtagcttgatggggatgacattgaatctgtaaattaccttgggcagtatggccattttcacgatattgattcctcctacccatgagcatggaatgttcttccatttgtttgtatcctcttttatttccttgagcagcggtttgtagttctccttgaagaggtctttaacatcccttgtaagttggattcctaggtattttattctctttgaagcaattgtgaatgggagttcactcatgatttggctctctgtttgtctgttgttggtgtataagaacgcttgtgatttttgaacattgattttgtatcctgagactttgctgaagttgcttatcagcttaaggagattttgggctgagacagtggggttttccagatatacaatcatgtcatctgcaaacagggacagtttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagacttgcatcccagggatgaagcccacttgatcatggtggataaactttttgatgtgctgctggatttgttttgccagaattttattgaggatttttgcatcaatgttcatcaaggatattggtctaaaattctcttttttggttgtgtctctgcctgtctttggtatcagaatgattctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagaaattcaacttcttcctggtttagtcttgggagagtgtatgtgtcgaggaatttatccagttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgttagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgagtcccagagattctggtatgttgtgtctttgttctcattggtttcaaagaacatctttatttctgccttcatttcgttatgtatccagtagtcattcaggagcaggttgttcagtttccatgtagttgagcggttttgagagagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagggttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaggttaatattgttgtgtgtgaatttgatcctgtaattatgatgttagctggtgattttgctcgttagttgatgcagtttcttcctagtctcgatggtctgtatattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggtttccctttgagggtaacccaacctttctctctggctgcccttaacattttttccttcatttcaactctggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtataccaatcagacgtagatttggtcttttcacatagtcccatatttcttggaggctttgctcatttctttttattcttttttctctaaacttcccttctcgcttcatttcatttatttcatcttccatcgctgataccctttcttccagttgattgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctgatcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtccattctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggactccttgagctgtggtgggctgggcccagttggagcttcccggctgctttgtttacctaagcaagcctgggcaatggcgggcgcccctccgccagcctcactgccgccttgcagtttgatctcagactgctgtgctagcaatcagcgagactccgtgggcgtaggaccctccgagccaggtgccggatataatctcgtggtgcgccgttttttaagcccgtccgaaaagcgcaatattcgggtgggagtgacccgattttccaggtgagtccgtcacccctttctttgactcagaaagggaactccctgaccccttgcgcttcccaagtgaggcaatgcctcgccctgcttcggctcacgcacggtgcgcacacccactgacccgcacccactgtctggcactccctagtgagatgaacccggtacctcagatggaaatgcagaaatcacccgtcttctgtgtcgctcacgctgggagctgtagaccggagctgttcctattcggccatcttggctcctccacgtat

SEQ ID NO: 12701 - DNA, 10635 bp, Homo sapiens
ttgtttggtttttttttaattatactttaagttttagggtgtatgtgcacattgtgcaggttagttacatatgtatacatgtgccatgctggtgcgctgcacccactaaccactaactcgtcatctagcattaggtatatctcccaatgctacccctcccccctacccccaccccaccacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccccacaaaggacatgaactcatcattttttatggctgcatagtattccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctacttctagatccctgaggaatcgccacactgacttccacaatggttgaactagtttacagtcccaacaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcctaaatgtcttcttttgagaagtgtctgttcatgtccttcgcccactttttgatggggttgtttgttttttcttgtaaatttgtttgagttcattgtggattctggatattagccctttgtcagatgagtaggttgcaaaaattttctcccattttgtaggttgcctgttcactctgatggtagtttcttttgctgtgcagaaggtctttagtttaattagatcccatttgtctattttgtcttttgtttccattgcttttggtgttttagacaggaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatctcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacactggggttttctaaatatacaatcatgtcgtctgcaaacagggacaatttgacttcctcttttcctacttgaataccctttatttccttctcctgcctaattgccctggccagaacttccaacactatgctgaataggagtggtgagagagggcatccctgtcttgtgccagttttcaaagggaatgcttccagtttttgcccattcagtatgatactggctgtgggtttgtcaaatagctcttattattttgagagacgtcccatcaatacctagtttattcagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatattcatcaaggatattggtctaaaattctcttttttggttgtgtctctgcccggctttggtatcagaatgatgctggcctcatcaaatgagttagggaggattccctctttttctattgattggaatagtttcagaaggaatggtaccagttcctccttgtacctctgatagaattcggctgtgaatccatctggtcctggactctttttggttggtaaactattgattatcgccacaatttcagctcctgttattggtctattcagggattcaccttcttcctggtttagtcttgggagattgtatgtgtcgaggaatttatccatttcttctagattttctagtttatttgcgtagaggtgtttgtagtattctctgatggtagtttgtatttctgtgggatcagtggtgatatcccctttatcattttttttgtgtgtctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatgtctgttcttttacatttgctgaggagagctttacttccaagtatgtggtcaattttggaataggtgtggtgtggtgctgaaaaaaatgtatattctgttgatttggggtggagagttctgtagatgtcaattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacctctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgccttttaattggagcattaagtccatttacatttaaagttaatattgttatgtgtgaatttgatcctgtcattatgatgttagctggtgattttgctcgttagttgatgcagtttcttcctattctcgatggtctttacattttggcatgattttgcagcggctggtaccagttgttgctttccatgtttaccgcttccttcagaagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttcctttatttcacctttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatgagacgtagatttggtcttttcacatagtcccatacttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttcaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttccactttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcttcctggagctgtggtgggctccactcagttcgagcttcccggctgctttgtttacctaagcaagccagggcaatggcgggcgcccctcccccagcctcgctgtcgccttgcagtttgatctcagactgctgtgctagcaatctgtgagactccgtgggcgtaggaccctccgagccaggtgcaggatataatctcgtggtgcgccgttttttaagccggtcggagaagcgcaatattcgggagggagtgacccgattttccaggtgcgtctgtcacccctttctttgactcggaaagggaactccctgaccccttgcgcttcccaagtgaggcaatgcctcgccctgcttcggctcgcccacggtacgcgcgctcactgacctgcgcccactgtctggcactccctagtgagatgaacccggtacctcagatggaaatgcagaaatcaccagtcttctgcgtcgctcacgctgggagctgtagaccggagctgttcctattcggccatcttcgattgcaaaaattttctcccattctgtaggttgcctgttcactctgatggtagtttattttgctgtgcagaagctcattagtttaattagatcccatttgtctattttggcttttgttgccattgctttcggtgttttagtcatgaagtccttgcctatgcctatgtcctgaatggtaatgcctaggtttttcttctagggtttttatggttttgggtctaacatttaagtctttaatccatcttgaattaatttttgtataaggtgtaaggaagggatccagtttcagctttctacatatggctagccagttttcccagcaccatttattaaatagggaatcctttccccgtttcttgtttttgtcaggtttgtcaaagatcagatgtttgtagatatgtggtattatttctgagggctctgttctgttccattggtctacatctctgttttcttaccagtaacatgctgttttagttactgtagccttgtagtatagcttgaagtcaggtagcatgacgcctccagctttgttcttttggcttaggattgtcttgacaatgtgggctcttttttggttccatatgaactttaaagtagttttttccaattctgtgaagaaagtcaatggtagcttgatggggatgacattgaatctataaattaccttgggcagtatggccattttcacgatattgattcttcctatccatgagcatggaatgttcttccatttgtttgtgtcctcttttatctcattgagcagtggtttgtagttctccttgaagaggtccttcacatcccttgtaagttggattcctaggtattttattctctttgaagcaattgtgaatgggagttcactcatgatttggctctgtttgtctgttattggtgtatagtaatgcttgtgatttttgcacattgatgttgtatcctgagactttgctgaagttgcttatcagcttaaggaggtttcgggctgagacactggggttttctaaatatacaatcatgtcatctgcagacagggacaatttgacttcctgttttcctaactgaataccatttatttctttctcctgcctgattgccctggccagaacttccaacactatgttgaataggggtggagagagagggcatccctgtcttgtgccagttctcaaagggaatgcttccagtttttgcccattcagtatgatactggctgtgggtttgtcaaatagctcttattattttgagagacgtcccatcaatacctagtttattcagagtttttagcatgaagggctgttgaattttgtcaaaggcctttttctgcatctattgagataaacatgtggtttttgtctttggttctatttatatgatggattacgtttattgatttgcatacgttgaacaagccttgcatcccagggatgaagccaacttgatcatggtggataagctttttgatgtgctgctggattcggtttgccagtattttattgaggattttcacatcgatgttcatcagggatattggtctaaaattctctttttttgttgtgtctctgcccggctttggtatcaggatgatgctggcctcataaaatgagttagggaggattccctctttttctattgattggaatagtttcagaaggaatggtaccagctcctctttatacctgtggtagagttcagctatgaatccatctggtcctgggctttttttggttggtagtctattaattattgcctcaacttcagagcctgttattggtctattcagggattcgacttcttcctggtttagtcttgggagggtgtatgtgtccaggaatttatctgtttcttctagattttctagtttatttgcatagaggtgtttatagtattctctgatggtagtttgtatttctgtgggattggtggcgatatcccctttatcattttttattgcatctatttgattcttctctcttttcttctttattagtcttgctagcggtctatcaattttgttgatcttttcagaaaaccagctcctggattcattaattttttgaagggtttttttgtgtctctatccccttcagttctgctctgatcttagttatttcttgttttctgctagcttttgaatgtgtttgctcttgcttctctagttcttttaattgtgatgttacggtgtcgattttagatctttcctgctttctcttgtgggcatttagtgctataaatttccctctacacactgctttgaatgtgtcccagagaatctggtatgttgtgtctttgttctcattggtttcaaaaaacatctttatttctgccttcatttcgttatgtacccagtagtcattcaggaggaggttgttcagtttccatgtagttatgcggttttgagtgagtttcttaatcctgaattctaatttgattgcactgtggtctgagagacagtttgttataatttctgttcttttacatttgctgaggagtgctttacttccaactatgtggtcagttttggaataagtctgatgtggtgctgagaagaatgtatattctattgatttggggtggagagttctgtagatgtctattaggtccagttggtgcagacttgagttcaagtcctgggtatccttgttaactttctgtcttgttgatctgtctaatgttgacagtggggtgttaaagtctcccattattaatgtgtgggagtctaagtctctttgtaggtctctaaggacttgctttatgaatctgggtgtatatatatttaggatagttagctcttcttgttgaattgatccctttaccattatgtaatggccttgtctcttgacctttgttggtttaaagtcggttttattggagactaggactgcaacccctgcttttttttgttttccatttgcttggtagatcttcctccatccctttattttgagcctgtgtgtgtgtctgcatgtattcagcagatgggacccctgaatacagcacactgatgggtcctgactgtttatccagtttgccagtctgtgttttttaattggggcatttagtccatttacatttaaagttaatattgttatgcgtgaatttgatcctgtcattatgatgttagccggttattttgcccattagttgatgcagtttcttcctagcatcgatgatgtttacaatttggcatgttttgcagtggctggtactgatggttcctttccatgtttagtgcttccttcaggagctcttgtagggcaggcctggtggtgacagaatctctcaggatttgcttgtaaatttgtctgtaaaggattttatttctccttcacttatgaagcttagtttggctggatatgaaattctgattgaaaattctttaagaatgttgaatattggcccccactctcttctggcttgtagggtttctgccgagagatctgctgttagtctgatgggcttccctttgtgggtaacccgacctttctctctggctgcccttagcattttttccttcatttcaactttggtgaatctgacagttatgtgtcttggggttgctcttctcaaggagtgtctttgtggtggtctctgtatttcgtaaatttgaatgttggcctgccttgctaggttggggaagttctcctggataatatcctgaagagtgttttccagcttggttccattctccctgccacttacaggtacaccaatgagacgtagatttggtcttttcacatagtcccatatttcttggaggcttctttcgtttctttttactcttttttctctaaacttatcttctcacttcatttcattaatttgtgcttcagtcactgataccctttcttccacttgatggaatctggtactgaagcttgtgcatgtgtcacgtagttctcgtgccatggttttcagctccatcagatcatttaaggtcttctctatgctgtatattctagttagccattcgtctaatcttttttcaaggtttttagcttccttgtgacgggttcaaacatcttcctttagcttggagaagtttgttactaccaactttctgaagtctacttctgtcaactcgtcaaagtcattctccgtcctgttttgttcccgttgctggcaaggagctgtgatacttggaggagaaggggtgctctggtttttagaattttcatcttttctgctctggtttctccccatctttgtggttttatctacctttggtctttgctgatagtgacctacagatggggttttggtgtggatgtcctttttgttgatgttgatgctattccttcctgtttgttagttttccttctaacagtcaggtccctcagctgcaggtctgttggagtttgctggaggtccactccagaccctgttgcctaggtatcaccagcggaggctgcagaacagcaaatattgcagaacagcaaatattgctgcctgatccttcctctggaagcttcgtctcagaggggcacccagctgtatgaggtgtcaatcagcccctactgggaggtgtctcccagttaggctactcgggggtctgggacccacttgaggaggcagtctgtcccttctcggatctcaaactccgtgct

SEQ ID NO: 12702 - DNA, 7503 bp, Homo sapiens
ttttttttttttattatactttaagttttagggtacatgtgcacattgtgcaggttagttacatatgtatacatgtgccatgctggtgcgctacacccactaactcgtcatctagcattaggtatatcttccaatgctatccctcccccctccccccccccaccacagtccccagagtgtgatattccccttcctgtgtccatgtgatctcactgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtatatatgtgccacattttcttaatccagtctatcattgttggacatttgggttggtgccaagtctttgctattgtgaataatgccgcaataaacatacgtgtgcatgtgtctttatagcagcatgatttatagtcctttgggtatatacccagtaatgggatggccgggtcaaatggtatttctagttctagatccctgaggaatcgccacactgacttccacaacggttgaactagtttacactcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgttttttggctgcataaatgtcttcttttgagaattgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagcactttagtttaattagatcccatttgtcaattttgtcttttgttgccattgcttttggtgttttggacatgaagtccttgtccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaggcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatggttgtgatttttgcacattgattttgtatcctgagactttgctgaagttgcttatcagcttaaggagattttgggctgagacaatggggttttctagatatacaatcatgtcatctgcaaacaaggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatattcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgagtcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatattgtgtctttgttctcgttggtttcaaagaacgtctttatttctgccttcatttcgttatgtacccggtagtcactcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgcttcatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgtcagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttctagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgcggttttatctacttttggtctttgatgatggtgatgtacagatgggttttcggtgtggatgtcctttctgtttgttagtttttcttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagacccactgctctcttcaaagctgtcagactgcttttttttttttttttttttttgagacagagtcccgctctgtcatccaagctggagtacagtggcgtaatctcggctcactgcaacctgcgcctcccacgttcaagcgatactcctgcctcagcctcccaagtaactgggattacaggtgcgtgctaccacacctggctaatttttgtatttttcatagaaattgggtttcccatgttgcccaggctggtctcaaactcctgacttcaaatgatctgacctcctcggcttcccaaagcgctgggattacaggcgtgaagcacgacgcctggccggggagaacatcttcaacttgataaacagtatcttcaaaaaacctacagcaaacgtcatacttaacagtgggaaactagaagctttcccactaagagcagaaataagccaaggatatccccactcaccactctttccaacaccggactggaagtcctagctaatgaaataaggcaagaaataaaaagaaaaataaaactgtctttgtttgcagatgacatgatcatccaagaagaaaatcaaaaaactgaaaccaggcagtgattacagcaagactgcaggatacaaaagtcaatcactttcctatataccagcaatgaacaagtggaatttgagattaaaaacacaataccatttacattagcacccctcagaatgaaacacttaggtataaatcttaaaaaaaattagaatatctatatgagaaaaattaaagaagtgattaaagaagtcagagcactaaagaaatggagagatattccatgttcatagacagggagattcaatatagtcaaggtgtcagttcttcccaacttcatctacagactcaatgcaatcccaatctaaatccagcaagttattttgcagatatcaacaaactgattctaaagtttacatggggaagcaaaagacccagaatggtcaaaaaaatattaaaagagaagaacaaagttaacgggctgacactatacgacttcaatacttataataaagctacaataaataagacagtgtggtatcaatgaaagaagagagaaacagaccaatggaacagaacagagagcccagaattcgaccctgataaatacagtgaattgatctttgacaaaggagcaaaggcaatacaatggagcaaggggtcttttcaacaaatgatgttggaataactggatatccacatacaaaaaagcgcctctagacaaagaccacagacccttcacaaaaattatctgaaatgaatcataggcctaaatgtaaaatgcaaacctataaagctcctagaagataacaggaaaaaatctagattatgttgggtaggatgatgactttttagatataataccaaaggcacaatctatgaaaataagaattgataagctaagctttattaaaattaaaattttcctctccatgaaaggcactgtcaagagaatgaaaagacaagccacagattgagaaaaaatatttacaaaagaaatatcctataaggataaatatttgtaaattgaatattcacagaagacatatctgataaaggataaatatttgcaagttgaatatttgcaaaagacatatctgataaaggactagtatccaaaatataaaaagaactcttaaaacacagtaagaaaacaatccaattttttaaaatgggccaaagaccttaacagatacctcaccaaagatgatatacagatagtaaataagcatatgaaaaaatgttccatatcatatgtcatcaggtaaatgcaaattaaaatgaggtacctctacatacctattagaatggccaaaatccaaaacaattacaacaccaaatattagcaagaatggggagccacaggaactctcgttcattgctggtgggaatgcaaaatgatccagccactttgcaagacagtttggcagcttcttaacaaactaaacatactcttattaagtccagcaattgcatttcttggtatttgcacaaaagagctgaaaacttatatacatacaaaacctgctataaacacagatgtttggccaggcatggtggctcacacctgtaatcccagcact

SEQ ID NO: 12703 - DNA, 6060 bp, Homo sapiens
ttttactactgtatctttttttttttgttttgttttttttaattatattttaagttttagggtacatgtgcacattgtgcaggttagttacatatgtatacatgtgccatgctggtgcgctgcacccactaacgtgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcaatagtttactgagaatgatggtttccaatttcacccatgtccctacaaaggacatgaactcatcattttttatggctgcatagtattccatggtgtatatgtgccacattttcttaatctagtctatcattgttggacatttgggttggttccaagtctttgctattgtgagtagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttactttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacctatgagcatggaatgttcttccatttgtttgtgtcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagtggtgagagagagcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaagatgatgctggcctcatgaaatgagttagggaggattccctctttttctattgattggaatagtttcagaaggaatggtaccagttcctccttgtacctctggtagaattcggctgtgaatccatctgatcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtttttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagcctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgtgtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttctatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttggatattggtccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggaattgctcttctcgaggagtatctttgtggtgttctctgtatttcctgaatctgaacattggcctgccttgctagattggggaagttctcctggataatatcctgcagagtgttttccaacttggttccattctccacatcactttcaagtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggtgctttgcgttttagagtttctagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgctggggggtgcctcccagttaggctgctcaggggtcaggggtcagggacccacttaaggaggcagtctgcccgttctcagatctccagctgcgtgctgggagaaccactgctctcttcaaagctgtcagacagggacacttaagtgtgcagaggttactgctgtctttttgtttgtctgtgccctgcccccagaggtggagcctacagaggcaggcaggcctccttgagctgtggtgggctccatccagttcgagcttcccggctgctttgtttacctaagcaagcctgggcaatggcgggcgcccctcccccagcctcgttgccgccttgcagtttgatctcagactgctgtgctagcaatcagtgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccagggcaggcaatgcctcgccctgcttcggctcgcgcacggtgcgcacacacactggcctgcgcccactgtctggcactccctagtgagatgcacctggtacctcagatggaaatgcagaaatcacccgtcttctgcgttctcacgctgggagctgtagaccggagctgttcctattcggccatcttggctcctccccgg

SEQ ID NO: 12704 - DNA, 6433 bp, Homo sapiens
tttttgtctttatttatttatttatttttattacactttaagttttagggtacatgtgcacaacgtgcaggtttgttacatatatatacatgtgccatgttggtgtgctgcacccattaacttgtcatttaacattaggtatatctcccaatgctacccctccaccctcccccaccacacaacaggccctggtgtgtgatgttccccttcctgtgtccaagtgttctcactgttcaattcccacctatgagtgagaacatgtggtgtttggttttttgtccttgtgatagtttgctgagaatgatggtttccagcttcatccatgtccctacaaaggacatgaactcatcattttttatggctgcatagtattccatggtgtatatgtgccacattttcttttctttttttttttttaattatactttaagttttagggtacatgtgcacattgtgcaggttagttacatatctatacatgtgccatgctggtgcgctgcacccactaactcgtcgtctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatctccctacaaaggacatgaactcatcattttttatggctgcatagtattccatggtgtatatgagccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgacttgttaatgattgacattctaactggtgtgagatgatatctcatagtggttttgatttgcatttctctgatggccagtgatgatgagcattttttcatgtgttttttggctgcataaatgtcttcttttgagaagtgtctgttcatgtccttcgcccaatttttgatggggttgtttgtttttttcttgtaaatttgtttgagttcattgtagattctggatattagccctttgtcagatgagtaggttgcgaaaattttcttccatgttgtaggttgcctgttcactctgatggtagtttcttttgctgtgcagaagctctttagtttaattagatcccatttggcaattttggcttttgttgccattgcttttggtgttttggacatgaagtccttgcccacgcctatgtcctgaatggtaatgcctaggttttcttctagggtttttatggttttaggtctaacttttaaatctttaatccatcttgaattgatttttatataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaggtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacatggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctcgattacatttattgatttgcgtatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttactagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacttctttatttctgccttcatttcgttatgtacccagtagtcattcaggagcaggttgttcagtttccatgtagttgagcggctttgagtgagattcttaatcctgagttctagtttgattgcacggtggtctgagagatagtttgttataatttctgttcttttccatttgctgaggagtgctttacttccaactatgtggtcaattttggaataggtgtagtgtggtgctgaaaaaaatgtatattctgttgatttggggtggagagttctgtagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatccttgttggtttaaagtctgttttatcagagactaggattgcaacccctgcctttttttgttttccacttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggttattttgcttgttagttgatgcagtttcttcgtagtctcgatggtctttacattttggcatgattttgcagcggctggtaccggttgttcctttccatgtttagcgcttccttcaggacctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccgcatcactttcaggtacaccaatcagacatagatttggtcttttcacatagtcccatatttcttggaggctttgctcatttctttttattcttttttctctaaccttcccttctcgcttcatttcattcatttcatcttccattgctgataccctttcttccagttgatcgcgtcggctcctgaggcttctgcattcttcacgtagttctcgagccttggttttcagctccatcagctcctttaagcacttctctgtattgcttattctagttatacattcttctaaattttttccaagttttcaacttctttgcctttggtttgaatgtcctcccgtagctcagagtaatttgatcgtctgaagtcttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatgttgatgtacagatgggttttcggtgtggatgtcctttctgtttgttagttttccttctaacagacaggaccctcagctgcaggtctgttggaataccctgccgtgtgaggtgtcagtgtgctcctgctggggggtgcctcccagttaggctgctcgggggtcaggggtcagggacccacttgaggaggcagtctgcccggtctcagatctccagctgcgtgctgggagaaccactgctctcttcaaagctgttagacagggacatttaagtctgcagaggttactgctgtctttttgtttgtctgtgccctgcccccagaggtggagcctacagaggcaggcaggcctccttgagctgtggtgggctccacccagttccagcttgccggctgctttgtttacctaagcaagcctgggcaatagcgggcgcccctcccctagcctcgctgccgccttgcagtttgatctcagactgctgtgctagcaatcagcgagactccgtgggcgtaggaccctccgagccaggtgtgggatatagtctcgtggtgtgccgttttttaagccggtctgaaaagcgcaatattcgggtgggagtgacccaattttccaggtgcgtccgtcacccctttctttgactcggaaagggaactccctgaccccttgcacttcccaggtgaggcaatgcctcgccctgcttcggctcgcgcacagtgcgcgcacctactggcctgtgcccactgtctggcactccccagtgagatgaacccggtacctcagatggaaatgcagaaatcacccgtcttccgcgtcgctcacgctgggagctgtagaccggagctgttcctattcggccatcttggctcctct

SEQ ID NO: 12705 - DNA, 6178 bp, Homo sapiens
tatctattaattaattaattaatttattattattatactttaagttgtagggtacatgtgcacaatgtgcaggttagttacatatgtatacatgtgccatgctggtgtgctgcacccattaactcgtcatttagcattaggtatatctcctaatgctatccctccccctccccccaccccacaacagtccccagagtgtgatgttccccttcctgtgtccatgtgttctcattgttcagttgccatctatgagtgagaatatgcgttgtttggttttttgtccttgcgatagtttactgagaatgatgatttccaatttcatccatgtccctacaaaggacatgaactcatcattttttatggctgcataggattccatggtgtatatgtgccacattttcttaatccagtctatcattgttggacatttgggttggttccaagtctttgctattgtcaatagtgccgcagtaaacatacgtgtgcatgtgtctttatagcagcatgatttatagtcctttgggtatatacccagtaatgggatggctgggttcaaatgtatttctagttctagatccctgaggaatcgccacagtgacttccacaatggttgcactagtttacagtcccagcaacagtgtaaaagtgttcctatttctccacatcctctccagcacctgttgtttcctgactttttaatgatcgctgttctaactggtgtgagatggtatctcattgtggttttgatttgcatttctctgatggccagtgatgttgagcattttttcatgtgtcttttggctgcataaatgtcttcttttgagaattgtctgttcatatcctttgcccactttttgatggggttgtttgtttttttcttgtaaatttgtttaagttcattgtagattctgaatattagccctttgtcagatgagtaggttgcaaaaattttgtcccattttgtaggttgcctgttcactccgatggtagtttcttttgctgtgcagaagctcttgagtttaattagatcccatttgtcaattttggcttttgttgccattgcttttggagttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccattttcagctttctacatatggctagccagttttcccagcaccatttattaaatagggaatcctttccccactgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgacgcgggctcttttttggttccatatgaactttaaagtagttttttccaattctgtgaagaaagtaattggtagcttgatggggataccattgaatctataaattaccttgggcagtatggccattttaacgatattgattcttcctacccatgagcatggaatgttcttccatttgtttgtatcctcttttatttccttgagcagtggtttgtagttctccttgaagaggtccttcacgtcccttgtaagttggattcctaagtattttattctctttgaagcaattgtgaatgggagttcactcatgatttggctctctgtttgtgtgttattggtgtataggaatgcttgtgatttttgtacattgattttgtatcctgagactatgctgaagttgcttatcagcttaaggtgattttgggctgagatgatggggttttctagatatacaatcatgtcatctgcaaacagggacaatttgacttcctcttttcctaattgaataccctttatttacttctcctgcctaattgccctggccagaacttccaacaatatgttgaataggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagataatcatgtggtttttgtctttggttctgtttatatgctggattacatttgatttgcgtatattgaaccagccttgcatcccagggatgaagcccacttgatcatggtggataagctttttgatgtgctgatggattcagtttgccagtattttattgaggatttttgcatcaatgttcatcaaggatattggtctaaaattctgttttttggtagtgtctctgcccggctttggtatcaggatgatgctggcctcataaaatgagttagggaggattccctctttttctattcattggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagattatttgcatggaggtgtttgtagtattctctgatggtagtttgtatttctgtgggatcagtggtgatatcccctttatcattttttattgcgtctatttgattcttctctcttttcttctttattagtcttgctagtggtctatcaattttgttgatccttccaaaaaaccagctcctggattcattaattttttgaagggttttttgtgtctctatttccttcaattctgctctgattttagttatttcttgccttctgctcgcttttgaatgtgtttgctcttgcttttctagttcttttaattgtgatgttagggtgtcaattttggatctttcctgctttctcttgtgggcatttagtgctctaaatttccctctacacactgctttgaatgtgtcccagagattctggtatgttgtgtctttgttctcgttggtttcaaataacatctttatttctgccttcatttcgttatgtacccagtagtcattcaggagcaggttgttcagttttcatgtagttgagcggttttgagtgattttcttaatcctgagttctagtttgattgcactgtggtctgagagacagtttgttataatttctgatcttttacatttgctgaggagagctttacttccaactatgtggtcagttttggaataggtgtggtgtggtgctgaaaaaaatgtatattctgttgatttggggtggagagttctgtagatgtctattaggtccacttggtgcagagctgagtttaattcctgggtatccttgttaactttctgtgtcattgatctgtctaatgttgacagtggagtgttaaagtctcccattattattgtgtgtgggaggctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggcttaaagtctgttttatcagagactaggattgcaatccctgcctttttttgttttccatttgcttagtagatcttactccatccttttattttgagcctgtgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcatgatgttagctggttattttgctcgttagttgatgcagttttttcctaatctcgatggtctttacattttggcatgattttgcagcagctggtaccggttgtgcctttccatgtttagtgcttccttcaggagctcttttaggtcaggcctggtggtgacaaaatctctcagcatttgcttgtctgtaaagtattttatttctccttcacttatgaagcttagtttggctggatatgaaattctgagttgacagttcttttctttaagaatgttgaatattggcccccactgtcttctggcttgtagagtttctgccgagagatcagctgttagtctgatgggcttccctttgtgggtaacctgacctttctctttggctgcccttaacattttttccttcatttcaactttggtgaatttgacaattatgtgtcttggagttgctcttctcgaggagtatctttgtggcgttctctgtatttcctgaatctgaacgttggcctgccttgctagactggggaagttctcctggatattatcctgaagagtgttttccaacttggttccattctccccatcactttcaggtacaccaatcagatgtagatttggtcttttcacatagtcccatatttcttggaggctttgttcgtttctttttattcttttttctctaaacttctcttctcgcttcatttcattcatttcatcttccatcactgataccctttattccagttgatcgcatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgattgtctgaagccttcttctctcaactcgtcaaagtcattctccatccagctttgttccgttgctggtgaggaactgcgttcctttggaggaggagaggcgctctgctttttagagtttccagtttttctgctctgtttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagtgctggctgcagaatagcagattttcgtgaaccgcgaatgctgctgtctgatcgttcctctggaagttttgtctcagaggagtacccggccgtgtgaggtgtcagtctgcccctactggggggtgcctcccagttaggctgcttgggggtcaggggtcaggacccacttgaggaggcagtctgcccgttctcagatctccagctgcacgctgggagaactactgctctcttcaaagctgtcagacagggacatttaagtctgcagaggttactgctgtctttttgtttgtctgtgccctgcccccagaggtggagcctacagaggcaggctggcctccttgagctgtggtgggctccacccagttcaagcttcctggctgctttgtttacctaagcaagcctgggcaatggtgggcgcccctcccccagcctggctgccgccttgtggtttgatctcagagtgctgtgctagcaatcagcgagactctgagcgtaggaccctctgagccaggtgagggatataatctcctggtgtgccatttcctaagcccgtcagaaaagcgcagtattcaggtgggagtggcccgattttccaggtgctgtctgtcacccctttccttgaccaggaaagggaactaactccctgacctgaccccttgcgcttcccaagtgaggcaatgcctcgccctgcttcggctggtgcacggtgcgttgcacccactgtcctgcgcctactgtctggcactccctagtgagatgaacccggtacctcaaatggaaatgcagaaatcacctgtcttctgagtagctgacactgggagctgtagactggagctgttcctatttggccatcttggctcctccc

SEQ ID NO: 12706 - DNA, 5807 bp, Homo sapiens
attttttttttatttttttaaattatactttaagttttagggtacatgtgcacaatgtgcaggtttgttacatatgtatacatgtgccatgttggtgtgatgcacccattaactcgtcatttagcattagttatatctcctaatgctgtccctcccgcctccccccaccccacaacagtccccagtgtgtgatgttccccttcctgtgtccatgtgttctcattgttcaattcccatctatgagtgagaacatgcaatgtttggttttttgtccttgtgatagtttgctgagaatgatggtttccagcttcattcatgcccctacaaaggacacgaactcatcattttttatggctgcatagtattccatggtgtatatgtgccacattttcttaatccagtctatcattgttggacatttcagttggttccaagtctttgctcttgtgaatagtgccgcaataaacatacatgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattctaaccggtgtgagatggtacctcattgtggttttgatttgcatttctctgatggccagtgatggtgagcattttttcatgtgttttttggctgcataaatgtcttcttttgagaagtgtctgttcatatccttcacccactttttggtggggttgtttttttcttgtaaatttgtttgagttcattgtagattctggatattagccctttgtcagatgagtaggttgcgaaaattttctcccgttttgtaggttgcctgttcactatgacagtgatttcttttgctgtgcagaagctctttagtttaattagatcccatttgtcaattttgtcttttgttgccattgcttttggtgttttagacatgaagtacttgcccatgcctatgtcctgaatcatattgcctagctttccttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccatttcttgtttttgtcaggtttgtcaaagatcagatagttgtagatatttggcattatttctgagggctctgttatgttccattggtctatatctctgttttggtaccagtaccatgctgttttggttactgtagccctgtagtatagtttgaagtcaggtagcgtgatgcttccagctttgttcttttggcttaggattgacatggcaatgcaggctcttttttggttccatatgaactttaaagtagttttttccaattctgtgaagaaattcattggtagcttgatggggatggcattgaatctataaattaccttgggcagtatggccattttcatgatattgattcttcctacccatgagcatggaatgttcttccatttgtttatatcctcttttatttcattgagcagtggtttgtagttctaggtccttcacatcccttgtaagttggaatcctatgtattttattctctttgaagcaattgtgaatgggagttcactcatgatttggctctctgtttgtctgttattgctgtataagaaagcttgtgatttttgcacattgattttgtatcctgagactttgctgaagttgcttatcagcttaaggagattttgggctgagaggatggggttttctagatatacaatcatgtcatctgcaaacagggagaatttgacttcttcttttcctaattgaatgccctttatttccttatcctgcctgattgccctggccagaacttccaacactatgttgaatacgagtggtgagagagggcatccctgtcttgtgccagttttcaaaaggaatgcttccagtttttgtccattcagtatgatattggctgtgggtttgtcgtagatagctcttattattttgagctatgtcccatcaatacctaatttattgagagtttttagcatgaagggttgttgaattttgtcaaacgccttttctgcgtttattgagataataatgtggtttttgtctttggttctgtttatatgctggattacgtttattgattttcatacgttgaaccagccttgcatcccagggatgaggcccacttgatcatggtggataagctttttgatgtgctgctggattcggtttgccagtattttattgaggatttttgcatcaatgttcgtcaaggatattggtctaaaattctctcttttttgttatgtctctgccaggctttggcattaggatgatgctggcctcataaaatgagttagggaggattccctctttttctattgattggaatggtttcagaaggaatggtaccagctcctccttgtacctctggtagaattcgactgtgaatccatctggtcctggactttttttggttggtaagctattaattattgcctcaatttcagagcctgttattggtctattcagagattcaacttcttcctggtttagtcttgggagagtgtatgtgtcgaggaatttatgcatttcttctagattttctagtttatttgtgtagaggtgtttatagtgttctctgatggtagtctgtatttctgtgagattggtggtgatatcccctttatcattttttattgcatcgatttgattcttctctcttttcttctttattagtcttgctagcagtctatcaattttgttgatcttttcaaaaaaccagctcctggattcattgatttttttgaagggtttattgtgtctctatttccttcagttctgctctgattttagttatttcttgccttcttgtagcctttgaatgtgtttgctgttgcttctctagttcttttaattgtgatgttagggtgtcaattttagatctttctgctttctcttgtgggcatttagtgctgtaaatttccctctacacactgctttgaatgtgtcccagagattctggtatgttgtgtctttgttctcattggtttcaaagaacatctttatttctgccttcattttgttatgtacccagtagtcattcaggagctggttgttcagttcccatgtagctgagcggttttgagtgagtttcttaatcctgagttctagtttgattgcactgtggtctgagagacagtttgttataatttctgttcttttacatttgctgaggagtgctttacttccacctatgaggtcaattttggaataggtgtggtgtggttctgagaagaatgtatattctgttgatttggggtggagagttctgtagatgtctattaggtccgcttggtgcagagctgagttcaattcctgtatatccttgttaactttctgtcttgttgacctgtctaatattgacagtgcagtgttaaagtctcccattattattgtgtgggtgtctaagtctctttgtaggtcactaaggacttgctttatgaatctgggtgctcctgtattgggtgcatatatatttaggatagttagttcttcttgttgaattgatccctttaccattatgtaatggccttctttgtgtgttttgatctttgttggtttaaagtctgttttatccaagactaagattgcaacccctgcctttttgtgttttccatttgcttggtagatcttcctccatccttttgttttgagcttatgtgtgtctctgcatgtgagatgggtttcctgaatacagcacactgatgggtcttgactctttatccaatttgccagtctgtgtcttttaattggagcatttagcccatttacatttaaggttagtattgttatgtgtgaattttatcctatcattatgatgttagctggttattttgctcattagttgatgcagtttattcctagcctcgatggtctttacaatttggcatgtttttgcagtggctggtaccggttgttcctttccatgtttaatgcttccttcaggagctcttttagagcaggcctggtggtgacaaaatctctcagcatttgcttgtctgtaaagtattttatttttccttcatttatgaagcttagtttggctgaatatgaaattctgggttgaaaattcttttctttaggaatattgaatattggcccccactctcttctggcttgtagagtttctgctgagagatctgctgttagtctgatgggcttctctttgtgggtaacccgacctttctctctggttgcccttaacattttttccttcatttcaactttggtgaatctgacaattatgtgtcttggagttgctcttctcgaggagtatctttgtggcattctctgtatttcctgaatctgaatgttggcctgacttgctagattggggaagttctcctggataatatcctgcagagtgttttccaacttggttccattctccctgtcactttcaggtacaccaatcagacgtagatttggtcttttcacatagtcccatatttcttggaggctttgtttgtttcgttttattcttttttctctaaacttcttttcacacttcattgtattcatttgatcttccatctctgataccctttcttcccgttgatcacatcagttactgaggattgtgcatttgtcatgtagttcttgtgccgtgcttttcagctccatcagttcctttaacgacttctctgcattggttattctagttatccattcgtctaattttttttcaaagtttttaatttctttgccgttggttcgaacttccttctttagctcggagtagtttgatcttctgaagccttcctctctcaactcatcaaagtcattctccatctagctatttcctttgctggtgaggagctgcattcctttggaggaggagaggcactctgatttttagagtttccagtttttctgctctgttttttccccatctttgtggtttttatctacctttggtctttgatgatggtgatgtacagatgggcttttggtgtagatgtcctttctgtttgttagttttccttctaatagtcaggaccctcagctgcaggtctgttggagtttactggaggtccactccagaccctgtttgcctgggtatcagcagcagtggctgcagaacagtggatattggtgaactgcaaatgctgctacctgatcgttcctccggaaattttgtctcagaggagtacccggccgtgtgaggtgtcagtacgcccctactggggggtgcctcccagttaggctgctggggggtcagggacccgcttgaggagccagtctgcccgttctcagatctccagctgcatgctgggagaaccactgctctcttcaaaactgtcagacagggacatttaagtctgcagaggttattgctgtcttttgtttgtctgtgccctgcccccagaggtggagcctacagaggcaggcaggcctccttgagctgtggtgggctccacccagttcaagcttcagggccgctttgtttacctactcaagcctgagcaatggcaggcgcccctcccccagccttgctgctgccttgcagtttgatctcagactgctgtgctagcagtgagcgaggctccatgggcgtaggaccctctgagccaggtg

SEQ ID NO: 12707 - DNA, 6032 bp, Homo sapiens
tttggtagatttcctttttttttttttttattatactttaagttttagggtacatgtgcacattgtgcaggttagttacatatgtatacatgtgtcatgctggtgcgctgcacccactaactcgtcatctagcattaggtatatgtcccaatgctatccctcccccctccccccaccccaccacagtccccagaatgtgatattccccttcctgtgtccatgtgatctcattgttcaattccacctatgagtgagaatatgcggtgtttggttttttgttcttgcgatagtttacggagaatgatgatttccaatctcatccatgtccctacaaaggacatgaactcatcattttttatggctgcatagtattccatggtgtatatgtgccacattttcttaatccagtctatcattgttggacatttgcgttggttccaagtctttgctattgtgaatagtgccgcaataaacatacgtgtgcatgtgtctttatagcagcgtgatttatagtcctttgggtatatacccagtaatgggatggctgggtcaaatggtatttctagttctagatccctgaggaatcaccacactgacttccacaatgattgaactagtttacagtcccaccaacactgtaaaagtgttcctatttctccacatcgtctccagcacctgttgtttcctgactttttaatgatcgccattctaactggtgtgagatggtatctcattgtggtttggatttgcatttctctgatggccagtgatgatgagcattttttcatgtgttttttggctgcataaatgttttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttcattagatcccatttgtccattttggcttttgttgccatttcttttggtgttttggacatgaagtccttgcccatgcctatgtcctgaatggtaatgcctaggttttcttccagagtttttatggttttacgtctaacatttaagtctttaatccatcttgaattgatttttgtataaggtgtaaggaagggatccagtttcagctttctccatatggctagccagttttcccagcaccatttattaaatagggaatcctttccccatttcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctgtttcttggttccatatgaactttaaagtatttttttccaattctgtgaagaaaggcattggtagcttgatggggatgacattgaatctgtatattaccttgggcagtagggccattttcacgatattgattcttcctacccatgagcatggaatgttcttccatttatttgtatcctcttttatttccttgagcagtggtttgtagttctccttgaagaagtccttcacatcccttgtaagttggattcctagctattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagatttggggctgagacaatggggttttccagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaataggtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccactcgatcatggtggataagctttttgatgtgctgctggattcgttttgccagaattttatgaggatttttgcatcaatgttcatcaaggatattgttctaaaattctcttttttggttgtgtctctgccaggctttggtatcagaatgatgctggcctcataaaatgagttagggaggattccctctttttctattgattggaatagtttcagaaggaatggtaccagttcctccttatacctctggtagaattcggctgtgaatccatctggtcctggactctttttggttggtaaactattgattattgccacaatttcaggtcctgttattggtctattcagagattcaacttcttcctggtttagtcttgggagagtgtatgtgtcaaggaatttatccatttcttctagattttctagtttatttgtgtaggggtgtttgtagtattctctgatggtagtttgtatttctgtgggatcggtggtgatatcccctttatcattttttattgtgtctatttgattcatctctctttctttctttattagtcttcctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcgtttcgttatttatccagtagtcattcaggagcaggttgttcagtttccatgtagttgagcggttttgagtgagattcttaatcctgagttctagtttgattgcactgtggtctgagagatagtttgttataatgtctgttcttttacatttgctgaggagagctttacttccaagtatgtggtcgattttggaataggtgtggtgtggtgttgaaaaaaatgtatattctgttgatttggggtggagagttctgtagatgtttattaggtctgcttggtgcagagctgagttcaattcctgggtatccttgttgactttctgtctcgttgatctgtctaatattgacagtggggtgttaaagtcccccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatatggcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttatattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggtttaaaattcttttctttaagaatgttgaatattggcccccactctcttctggcttgtagggtttctgccgagagatccgctgttagtctgatgggcttccctttgagggtaacccgacctttctctctggctgcccttaacattttttcctttatttcaactttggtgaatctgacaattatgtgtcttagagttgctcttctcgaggagtatctctgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcatttatttcatcttccattgctgatacccttccttccagttgatcacattggctcctgaggcttctgtgttcttcacgtagttctcgagccttggttttcatctccatcagctcctttaagcacttctctgtattggttattctagttatacattcttgtaaatttttttcaaagttttcaacttccttgcctttggtttgaatgtcctcccgtagctcagagtaatttgatcgtctgaagccttcttctctcagctcgtcaaagtcattctccatccagctttgttccattggtggtgaggaactgcgttcctttggaggaggagaggcactctgcgttttagagtttccagtttttctgttctgttttttccccatctttgtggttttatctatttttggcctttgatgatggtgatgtacagatgggtttttggtgtggatgtcctttctgtttgttagttttccttctaacagacaggaccctcagctgcaggtctgttggaataccctgccgtgtgaggtgtcagtgtgtccctgctgggggtgcctcccagttaggctgctcaggggtcaggggtcagggacccacttgaggaggcagtctgctggttctcagatctccagctgcgtgctgggagaaccactgctctcttcaaagctgtcagacagggacatttaagtctgcagaggttactgctgtctttttgtttgtctgtgccctgccccgagaggtggagcctacagaggcaagcaggcctccttgagctgtggtgggctccacctagttcgagcttcctggctgctttgtttacctaagcaagcctgggcaatggcgggcgcccctcccccagcctggctgccgccttgcagtttgatctcagactgctgtgctagcatcagcgagactccgtgggcgtaggaccctctgagccaggtgcgggatataatctcgtggtgtgcagttttttaagcaggtccgaaaagcgcaatatttcggtgggagtgaccagattttccacgtgcgtccatcacccctttctttgactcggaaagggaactccctgaccccttgcgcttcccaagtgaggcaatgcctcgccctgcttgggctcgcgcacggtgcgtgcacccactgacccacgcccactgtctggcactccctagtgagatgaacccggtacctcagatgaaaatgcagaaatcacccgtcttctgcgttgctcacgctgggagctgtagacaggagctgttcctatttggccatctt

SEQ ID NO: 12708 - DNA, 6850 bp, Homo sapiens
ttttttttttaatttttttattattattattatactttaagttttaaggtacatgtgcacaacatgcaggtttgttacatatgtatacatgggccatgttggtgtgctgcacccattaactcatcatttagcattaggtatatctcctaatgctatccctccccactcccccaaccccacaacagtccccggtgtgtgatgttccccttcctgtgtccatatgttctcattgttcagttcccacctatgagtgagaatgtgcggtgtttggtttttttgtccttgcgatagtttgctgagaatgatggtttccagcttcatccatgtccctacaaaggacatgaactcatcattttttatggctacatagtattccatggtgtatatgtgccacattttcttaatccagtctgtcattgttggacatttgggttggttccaagtctttgctattgcgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctctacatcctctccagcacctgttgtttcctgactgtttaatgatcgccattctaactggtgtgagatggtatctcattttggttttgatttgcatttctctgatggccagtgatgatgagcattttttcatgtgtgttttggctacataaatgtcttcttttgacaaatgtctgttcatatcctttgcccactttttgatggggttgtttttttcttgtaaatttgtttgagttcattgtagattctggatactagccctttgtcagatgagtaggttgcaaaaattttctcccattctgtaggttgcctgttcactctgatggtggtttcttttgttgtgcagaagctctttagtttaattagatcccatttgtcaattttggcttttgttgccattgcttttggtgttttagacatgaagtccttgtccatgcctatgtcctgaatggtattgcgtaggttttcttctagggtttttatagttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattggtctatatctctgttttggtaccagtaccatgctgttttgtttactgtagccttgtagtatagtttgaagtcaggtagcgtgatgcctccagctttgttcttttggcttaggattgacttggcaatgtaggctcttttttggttccatatgaactttaaagtagttttttccaattctgtgaagaaagttgttggtagcttgatggggatggcattgaatctataaattaccttgggcagtatggccattttcacaatattgagtcttcctacccatgagcattgaatgttcttccatttgtttgtatcctcttttatttcattgagcagtggtttgtagttctccttgaagaggtccttcacatcccttgtaaattggattcctaggtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctatgtgtacaatcatgtcatctgcaaattgggacaatttgacttcctcttttcctagttgaatgccctttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggttctgtttatatgctggattacgtttattgattttcttatgttgaaccagccttgcatcccagggatgaagcccacttgatcatggtggataagctttttgatgtgttgctggattcggtttgccagtattttattgaggatttttgcatcaatgttcatcaaggatattggtctaaaattctctttttttgttatgtctctgcccggctttggtatcaggatgatgctggcctcataaaatgtgttagggaggattccctctttttctatttattggaatagtttcagaaggaatggtaccagctcctccttgtgcctctggtagaattcggctgtgaatccatctggtctggactttttttggttggtaagctattaattattgcctcaatttcagatcctgttattggtctattcagagattcaacttcttcctggtttagtcttgggagagtgtatgtgtcgaggaatttatccatttcttctagattttctagtttatttgcatagaggtgtttatagtattctctgatggtagtttgtatttctgtgggagcagtggtgatatcccctttatcattttttattgcacctatttgattcttctctcttttcttctttattagtcttgctagcggtctatcagttttgttgatcttttcaaaaaaccagctcctggattcattgatttttttgaagggttttttgcgtctctatttccttcagttctgctctgatcttagttatttcttgccttctgctagcttttgaatgtgtttgctcttgcttctctagttttttttttttttttttttttagtatttattgatcattcttgggtgtttcttggagggggtatgtggcagtgtcataggataatagtggagagatggtcagcagataaacacgtgaacaaaggtctctggttttcctagacagaggtccctgtggccttccgcagtgtttgtgtccctgggtacttgagattagggagtggtgatgactcttaatgagcatgcagcctttaagcatctgtttaacaaagcacatcttgcactgcccttaatccatttaaccctgagttgacacagcacatgtttcagagagcacggggttgggggtaaggttatagattaacagcatcccaaggcagaagaatttttcttagtccagaacaaaatggagtctcctatgtctacttctttctagacagacacagtaacaatctgatctctctttcttttccccacatttcccccttttcttttcaacaaaaccgccatcgtcatcatggcctgttctcgacggtcgctgtctcttcggagctgttgggtacacctcccagacggggcggccgggcagaggtgctcctcacttcccagacggggtggccgggcagaggagctcctcacatcccagacagtgggcggccaggcagaggctctcctcacctctcagacggggcagccgtgcagaggcgctcctcacctcccagacggggcagccgggcagaggcgctcctcacctcccagacggggcggccgggcagaggcgctcttcacctcccagacagggcggcagggcagaggcgcttcccacctccctgacggggcggccgggaagaggcgcccctcacctcccagacggggcggccgggcggaggcgctcctcacatcccagacaggacggctgggcagaggcgctcctcacttcccagacgacgggcggccgggcagaggcactcctcacctcccagacagggtggctgggcagagacgctcctcacctctcagacagggcggccggacagaggcgctcgcttcctagatggggcggccgggcagaggcgctccttacctcccagacgaagggtggccgggcagaggtgctcctcacatcccagacgatgggcggccgggcagaggcgctcctcacttcctagatggggcggccgggcagaggtgctcacttcccagatggggcggctgggcagaggcgctcctcacctcccagatgatgggcagccaggcagaggcgctcctcacctcccagacggggcggccgtgcggaggcgctcctcacctcccagacggggcggccgggcggagacgctcctcacctcccagatggggcggccgggcggaggcgctcctcacctcccagacgggttggccaggcagatctctagttctttcaattgtgatgttagggtgtcaattttagatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggtagttcagtttccatgtagttgagcagttgtgagtgagtttcttaatcctgagttctagtttgattgcactgtggtctgagagacagtttgttataatttctgttcttttacatttgctgaggtgtgctttacttccaactatgtggtcaactttggaataggtgtggtgtggtgctgaaaagaatgtatattctgttgatttggggtggagagttctgtagatgtctattaggtctgcttggtgcagagctgagttcaattcctggatatctttgttaactttctgtctcgttgatctgtgttgacacagtggggttgttgacagtggggtgttaaagtctcccattattattgtttgggagtctaagtctctttgtaggtcactaaggacttgctttatgaatctgggtgctcctgtattgggtgcatatatatttaggatagttagttcttcttgttgaattgatccctttaccattatgtaatggtcttgtctcttttgatctttgttggtttaaagtctgttttatccgagactaggattacaacccctgcctttttttgttttccatttgcttggtagatcttcctccatccctttattttgagcctatgtgtgtttctgcacatgagatgggtttcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattattttctttaagaatgttgaatattggccctcactctcttctggcttctagagtttctgccgagagatcagctgttagtctgatgggcttccctttgtgggtaacccgacctttctctctggctgcccttaacattttttcctttatttcaactttggtgaatctgacaattatgtgtcttggagttgctctgctcgaggagtatctttgtagcattctctgtatttcctgaatttgaatgttggcctgccttgctagattggggaagttctcctggataatatcctgcagagtgttttccaacttggttccattctccccgtcactttcaggtacaccaatcagacgtaaatttggtcttttcacatagtcccatatttcttgcaggctttgttcatttctttttattcttttttctctaaacttctcttcacgcttcatttcattcattttgtcttccatcactgataccctttcttccagttgattgcatcggttactgaggcttgtgcattcgtcacgtagttctcatgccatggttttcagctccatcaggtcctttaaggacttctctgcatgggttattctagttatccattcgtctaatttttttcaaggtttttaacttctttgccattggttcgaacttcctcctttagctcagagagtttgatcttctgaagcctttctctctcaactcgtcaaagtcattctccatccagctttgttccgttgctggtgaggagctgcgttcctttggaggaggagaggcgctctgatttttagagtttccggtttttctgctctgttttttccccatctttgtggttttatctacctttgttctttgatgatggtgacgtacagatgggtttttggtgcagatgtcctttctgtttgttagttttccttctaacagtcaggaccctcagctgcaggtctgttggagtttactggaggtccactccggaccctgtttgcctaggtatcagcagtggtggctgcagaacagcagatagtgctgaaccgcaaatgctgctgcctgatcgttcctctggaagttttgtctcagaggagtacccggcagtgtgaggtgtcagtccgcccctactggggggtgcctcccagttagg

SEQ ID NO: 12709 - DNA, 6062 bp, Homo sapiens
ttttgttttttctttttgtctttttattttattttattttatttttatttcttttttattatactttaagttttagggtacatgtgcacattgtgcaggttagttacatatgtatacatgtgccatgctggtgcgctgcacccactaactcgtcatctagccttaggtatatctcccaatgctatccctccccgctccccccaccccaccacagtccccagagtgtgatattcccctccacatgtccatgtgatctcattgttcaattcccacccatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggtaggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccgacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcacccactttttgatggggttgttttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcagatttgtcaaagatcagatagttgtaggtatgtggcgttatttctgagggctctgttctgttccattgatctatatctctgttttggtaccagtaccatgctgttttggttactgtaggcttgtagtatagtttgaagtcaggtagtgtgatgcctccagctttgttcttttggcttagggttgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcatatcccttgtaagttggattcctaggtattttattctctttgaagcaattgtgaatgggagttcactcatgatttggctccctgtttgtctgttgctggtgtataagaatgcttgtgatttttgtacattgattttgtatcctgagactttgctgaagttgcttatcagcttaaggagattttgggctgagacgatggggatttctagatgaacaatcatgtcgtctgcaaacagggacaatttgacttcctcttttcctaattgaataccctttatttccttctcctgactgattgccctggccagaacttccaacactatgttgaataggagtggtgagagagggcatcccctgtcttgtgccagttttcaaagggaatgcttccagtttttgcccattcagtatgatattggctgcgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatactggattacatttattgatttgcatatattgaaccagccttgcatcccagggatgaagcccacttgatcatggtggataagctttttgatgtgctgctggattccgtttgtcagtattttattgaggatttttgcatcaatgttcatcaaggatattggtctaaaattatcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgaatgcgtcccagagattctggtatgttgtgtctttgttctcgttggtttcaaagaacatctttatttctaccttcatttcgttatgtacccagtagtcattcaggagcaggttgttcagtttccatgtagttgagcagctttgagtgggattcttaatcctgagttctagtttgattgcactgtggtctgagagatagtttgttataatttgtgttcttttacatttgctgaggagaactttacttccaactatgtggtcaattttggaataggtgtggtgtggtgctgaaaagaatgtatattctgttgatttggggtggagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctggggtgaaaattcttttctttaagaatgttgaatattggcccccactctcttctggcttgtagggtttctgccgagagatccactgttagtctgatgggcttccctttgagggtaacccgacctttctctctggctgccctttacattttttccttcatttcaacttcggtgaatctgacaattatgtgtcttggagttgctcttctcgaggagtatctttatggcgttctctgtatttcctgaatctgaacgttggcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattgtagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttaccgctgtctttttgtttgtctgtgccctgcccccagagatggagcctacacaggcaggcatgcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggcgtagtaccctccgagccaggtgtgggatatagtctcgtggtgcgccgttttttaagccggtctgaaaagtgcaatattcgggtgggagtgacccgattttccaggtgcgtccgtcacccctttctttgactcagaaagggaactccctggccccttgcacttcccaggtgaggcaatgcctcgccctgcttcggctcgcacccggtgcgcgcacccactggcctgcgcccactgtctggcactccctagtgagatgaacccggtacctcagatggaaatgcagaaatcacccgtcttctgcgtcgctcacgctgggagctgtagactggagctgttcctattcggccatc

SEQ ID NO: 12710 - DNA, 6021 bp, Homo sapiens
ccatcttatttatttattttttttaattatactttaagttttagggtacatatgcacattgtgcaggttagttacatatgtgtacatgtgccatgctggtgcgctgcacccactaactcgtcatctagcattaggtatatctcccaatgttatgcctcccccctccccccaccccacaacagtccccagagtgtgatattccccttcctgtgtccatgtgatctcattgttcaattcccacctatgagtgagaatatgtggtgtttggttttctgttcttgtgatagtttactgagaatgatgatttccaatttcatccatgtccctgcaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcgtgcgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtagctcattgtggttttgatttgcatttctctgatggccagtgatgatgagcattttttcatgtgtcttttggctgcataaatgtcttcttttgagaagtgtctgttcatgtccttcgcccactttttgatggggttgtttgttcttttcttgtaaatttgtttgagttcattgtagattctggatattagccctttgtcagatgagtaggttgcgaaaattttctcccattttgtaggttgcctgttcactctgatggtagtttcttttgctgtgcagaagctctttaatttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatctttccccattgcttgtttttctcaggtttgtcaaagatcagatagctgtagataagcggcgttatttctgagggctctgttctgttccattgatctatatctctgttttgcatgctgttttggttactgtagccttgtagtatagtttgaagtcaggtagtgtgatgcctccagctttgttcttttggcttaggattgacttggcgttgcgggctcttttttggttccatatgaactttaaggtagttttttctaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggatttcactcatgatttggctctctgtctgttgttggtgtataagaatgcttgtgatttttgtacattgattttgtatcctgagactttgctgaagttgcttatcagcttaaggagattttgggctgggaccatgggcttttctagatatacaatcatgtcgtctgcaaacagggacaatttgacttcctcctttcctaattgaataccttttatttccttctcctgcctgattgccctggccagaacttccaacactatgttgaataggagtggtgagagagggcatccctgtcttgtgccacttttcaaagggaatgcttccagtttttgcccattcagtatgatattggctgtgggtttgtcatagatagctcttattattttgaaatacatcccatcaatacctaatttattcagagtttttagcatgaagggttgttgaattttgtcaaaggctttttctgcatctattgagataatcatgtggtttttgtctttggctctgtttatatgctggataacatttattgatttgcatatattgaaccagccttgcatcccagggatgaagcccacttgatcatggtggataagctttttgatatgctgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatgataccagctcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctatttgattcttctctctttttttctttattagtcttcctagtggtctatcaattttgttgatcctttcaaaaaaccagcttctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgccttctcttgtgggcatttagtgctataaatttccctctacacactgctttgaatgcgtcccagagattctggtatgttgtgtctttgttctcgttggtttcaaagaacatctttatttctgccttcatttcgatatgtacccagtattcattcaggagcaggttgttcagtttccatgtagtggagcggttttgagtgagattcttaatcctgagttctagtttgattgcactgtggtctgagagatagtttgttataatctctgttcttttacatttgctgaggagagctttacttccaagtatgtggtcaatttcggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttttcagagactaggattgcaacccctgcctttttttgttttccatttgcttggtagatcttcctccatccttttattttgagcctttgcgtgtctctgcacatgagatgggtttcctgaatacagcacactgatgggtcttgactctttatccaatttgccagtctgtgtcttttaattggagcatttagtccatttgcatttaaagttaatattgttatgtgtgaatttgatcctgtcattatgatgttagctggttcttttgctggttagttgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttatctgtaaagtattttatttctccttcacttatgaagcttagtttggctggatatgaaattctgggttgaaaattcttttctttaagaatgttgaatattggtccccactctcttctggcttgtagggtttctgccaagagatccgctgttagtctgatgggcttccctttgagggtaacccgacctttctctctagctgtccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgctttccaacttggttccattctccccatcactttcaggtacaccgatcagacgtagatttggtcttttcacatagtcccatatttcttggaggctttgctcatttccttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctgagctcgtcaaagtcattctccatccatctttgttccgttgctggtgaggaactgcgttcctttgaaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctgggggttgcctcccagttaggctgctcgggggtcagggacccacttgaggaggcagtctgcccgttctcagatctccagctgggtgctgggagaaccactgctctcttcaaactgtcagacagggacatttaagtctgcagaggttactgctgtctttttgtttgtctgtgccctgcccccagcggtggagcctacagaggcaggcaggcctccttgagctgtggtgggctccacccagttcgagcttcctggctgctttgtttacctaagcaagcctgggcaatggcgggcacccctcccccagcctcgctgccaccttgcagtttgatctcagactgctgtgctagcaatcagtgagactctgttggcgtaggtccctccgagccaggtgcgggatataatctcatggtgcgccgttttttaagcccctcggaacagcgcagtattcgggtgggagtgacccgattttccaggtgcgtctgtcacccctttctttgactcggaaagggaactccctgaccccttgcgcttcccaagtgaggcaatgcctcgccctgcttcggcttgcgcacggtgcgcgcacccactgacctgcgcccactgtctggcactcccaagtgagatgaacccggtacctcagatggaaatgcagaaatcacccgtcttctgcgtcactcatgctgggagttgtagacaggagctgttcctatttggccatcttggctcctccccc

SEQ ID NO: 12711 - DNA, 7175 bp, Homo sapiens
ttctttttttctttttttaattttattattattatactttaagttctagggtacatgtgcacagcgtgcaggtttgttacatatgtatacatgtgccatgttggtgtgctgcacccatcaactcatcatttagcattaggtatatctcctaatgctatccctcccccatcccctcaccccacaccagtccccagtgtgtgatgttccccttcctgtgttcatgtgttctcattgttcaattcccacctatgagtgagaacatgcggtgtttagttttttgtccttgtgatagtttgctgagaatgatggtttccagcttcatccatgtccctacaaaggacatgaactcatcattttttatggctgcatattcatggtatacacgtattccgtggtgtatatgtgccacattttcttaatccagtctaccattgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagcgctcctatttctccacagcttctacagcatctgttgtttcctgactttttaatgttcaccattctaactggtgtgagatggtatctcattgtggttttgatttgcatttctctgatggccagtgatgatgagcattttttcatgtgtctattggctgcataaatgtcttcttttgagaagtgtctgttcatatcctttgcccactttttgatgtggttgtttgtttttttcttgtaaatttgttaaagttcattgtagattctgaatattagccctttgtcagatgagtaggttgcaaaaattttctcccattctgtaggttgcctgttcactctgatggtagtttcttttgctgtgcagaagctttagtttaattagatcccctttgtcaattttggcttttgttcccattgcttttggtgttttagacatgaagtccttgcccatgcctacgtcctgaatggtattgcctaggttttcttctacagtttttatggttttaggtctaacatgtaagtctttaatccatcttgaattaatttttgtataaggtgtaaggaagggatccagtttcagctttctacatatggctagccagttttcccagcaccatttatgaaatagggaatcctttcctcatttcttgtttttgtcaggtttgtcaaagatcagatagttgtagatatgcagcattatttctgaggactctgttgtgttccattggtctatatctctcttttggtaccagtaccatgctgttttggttactgtagccttgtagtatagtttgaagtcaggtagcatgatgcctccagctttgttcttttggcttaggattgtcttggcaatgtgggatcttttttggtcccatatgaactttaaagaagttttttccaattctgtgaagaaagtcattggtagcttgatggagatggcattgaatcaataaattaccttgggcagtatggccattttcatgatattgattcttcctacccatgagcatggaatgttgttccatttgtttgtatcctcttttatttcattgagtagtggtttgtagttctcctcgaagaggtccttcacatcccttataagttgtattccaaggtattttattctctttgaagcaattgtgaatgggagttcactcatgatttggctctgtgtttgtctgttattggtgtataagaatgcttgcgatttttgcacattgattttgtatcctgagactttactgaagttgcttatcagcttaaggagattttgggctgagacgatggggttttctaaacatacaatcatgtcatctacaaacagggacaatttgacttcctcttttcctaattgaatgctctttatttccttctcctgcctgattgccttggccagaattttccaacactatgttgaataggagtggtgagagagggcatccctgtcttgtgccagttttcaaagggaatgcttccagtttttgtccattcagtatgatattggttgtgggtttgtcatagataacgcttattattttgagatacgtcccatcaatacctaatttattgagagtttttagcatgaagtgttgttgaattttgtcaaaggccttttctgcatctattgagataatcgtgtggtttttgtctttggttctgtttatatgctggattatgtttgttgattttcatatgttgaaccagccttgcatcccagggatgaagcccacttgatcatggtggataagctttttgatgtgctgctggatttggtttgccagtatattactgaggatttttgcatcaatgttcatcaaggatattggtctaaaattctctttttttgttgtgtctctgccaggctttggtatcagaatgatgctggcttcataaaatgagttagggaggattccctctttttctattgattggaatagtttcagaaggaatggtaccagctcctccttgtacttctggtagaattcggctgtgaatccatctggtcctggactttttttggttggtaaactattaattattgcctcaatttcggagcctgttattggtctattcagagattcaacttcttcctggtttagtgttgggagggtgtttgtgtcgaggaatttatccatttcttctagattttctagtttatttgcgtagaggtgtttatagtattctctgatggtagtttgtatttctgtgcgatcagtggtgatatcccctttatcattttttattgtgtctatttgattcttctctcttttcttctttattagtcttgctagcagtctatcaattttgttgatccattcaaaaaaccagctcctggattcatggattttttgaagggttttttgtgtctctatctccttcagttctgctctgatcttagttatttcttgccttctgctagcttttgaatgtgtttgctcttgcttctctggttcttttaattgtgatgttagggtgtcaattttggatctttcctgctttctcttgtgggcatttagtgctgtaaatttccctctacacactgctttgaatgtgtcccggagattctggtatgttgtgtctttgttctcattggtttcaaagaacatctttatttctgcctttatttttttatgtactcagtagtcattcaggagcaggttgttcagtgtccatgtagttgagtggttttgagtgagattcttaatcctgagttctagtttgattgcactgtggtctgagagacagtttgttataatttctgttcttttacatttgctgaggagtgctttacttccagctatgtggtcaattttggaataggtgtggtgtggtgctgaaaagaatgtatattctgttgatttggggaggagagttctgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcccatattgggtgcatatatatttaggatagttagctcttcttgttgaattgatccctttaccattatgtaatggcctcctttgtctcttctcatctttgtcggtttaaaatatgttttatcagagactaggattgcaatccctgcctttttttgttttgcatttgtttggtagatcttccaccctccctttattttgagcctatgtgtgtctctgcatgtgagatgggtctcctgaatacagcacactgatgggtcttgactctttatcccatttgccagtctgtgtcttttaattggagcatttagcccatttacatttaaggttaatattgttatgtgtgaatcttatcctgtcattatgatgttagctggttattttgctcgttagttgatgcagtttcttcctagcctcgatggtctttacaatttggtatgtttttgcaatggctggtaccagttgttcctttccatgtttagtgcttccttcaggagctcttttagggcaggccttgtggtgacaaaatctctcagtatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctcaggccgcccttaacattttttccttcatttcaactttggtggatccgacaattatgtgtcttggagttgctcttctcaaggagtatcttgttggcattctctgtatttcctgaatttgaatgttggcctgccttgctagattggggaagttctcctggataatatcctgcagagtgttttccaacttggttccattctccctgtcactttcaggtacaccagttagacatcgatttggtctttccacatagtcccatatttcttggaggctttgttcgtttctttttattattttttctataaacttctcttgtcacttcatttcattcatttcgtcttccatcactgataccctttcttccagttgatcgcatcggctactgaggcttgtgcattggtcacgtagttcttgtgccatggttttcagctccatcaggtcctttaaggacttctctgcattggttattctagtcagccattcgtctaattttttttcaaggtttttaacttctttgccattggttcgaacttcctcctttagctcggagtagtttgatcttctgaagccttcttctctcaactcatcaaagtcattctccatccagctttgttgcattgctggtgaggagctgcgttcctttggaggaggagaggcactctgatttttagagtttccagtttttctgctctgttttttccccatctttgtggttttatctacctttggtctttgatgatggtgacatacagatgggtttttggtgtggatgtcctttctgtttgttagttttccttctaacagtcaggaccttcagctgcaggtctgttggattttgctggaggtccactccagaccctgtttgcctgggtttgagcagcggtggctgcagaacagtggatattggtgaacctcaaatgctgctgcctgatcgttggttgctctggaagttttgtctcagaggagtacccggccatgtgaggtgtcagtctgcccctactgggggatgcctcccagttaggctactcgggggtcagggatccacttgaggaggcagtctgcctgttctcagatctcaagctgcgtgctaggagaaccactactctcttcaaagctgtcagacagggacatttaagtctgcagaggttactgctgccttttgtttgtctgttccctgctccagaggtggatcctacagaggcaggcaggcctccttgagctgtggtgggctccacccagttcgagcttcctggccactttgtttacctactgaagcctgggtaatggcaggcgcccctcccccagcctcattaccaccttgcagttttatctcagcctgctgtgctagcaatgagtgaggctccatgggcataggaacctgtgagccaggtgtgggatataatctcctggtgtgccgtttgttaagccctttggaaaagcgcagtattagggtgggagtgacccgattttccaggtgatgtctgtcacccctttctttgactaggaaagggaattccctgaccccttgtgcttcgcaggtgaggtgatgcctcaccctgcttcggctcacgcatggtgcactgcacccactgtcctgcacccactttccggcactccccagtgagatgaacccagtacctcagttggaaatgcagaaatcacccgtcttctgcgtcgctcacgctgggagctgtagactggagctgttcctattcggccatcttggcttcacctcccagcagattctcaagttattaaaatttttaaaattatgatttcattgttattaaaatatttaaaagtatgattttgttgtttcagaatggttaaaatatgagtaggaatgggagatttggctggtctttgtccctggcttcttggaaaggacctccaaattcttggaaatttcatgagtgatggattggattaagaagcaacggaatgtaatcccagcattttgggaggccaaggcaggtggatcacctgaagtcaggagttggagaccagcctggccaacatggtgaaaccctgtttctactaaaaatacaaaaattagccagtcgtggtggtgtgtacctgtaatccctgctactcgggaggctaaggcaagagaatcgcttgaacctgggaggcagaggtttcagtgagctgagatcgtgccactgcactccagcctgggtaacagagtgagaccctgtcataagataaataaatacgtaaataaaataaataagaatggcaatatcagagggctccaaatagcaggacgtataatggaagagcttattgctaatataattgtttgatcaattagcaaaattgggtagaagttagggtgctgtaaaataatttaaaaaatttggggttgcttgcacacagcttctaaaacccttagaatatctgtagtcctgagagtatcggccaggcgcggcggctcacacctgtaatcccagcaccttgggaggcggaggcgggcggatcacgaggtcaagagatcgagaccatcctggccaacatggtgaaattccgtctctactaaaaatacaaaaattagccaggtgtgatggtggacgcctgtaatcccagctactgaggaggctaaggcgggagaatcgcttggaggcaggagaatcacttgaactcaggaggcagaggttgcagtgagctaagattgcgccactgcactccagcgtggtgacagagcgagactccatctcaaaaaat

SEQ ID NO: 12712 - DNA, 5584 bp, Homo sapiens
atttaatttttttttatactttaagttctagggtacatgtgcacaaagtgcaggtttgttacatatgtatacatgtgccatgttggtgtgctgcaccgattaattcgtcatttacattaggtatatctcctaatgctatccctccccgctccccacaccccatgacaggccccagtgtgtgatgttccccttcctgcgtccaagtgttttcattgttcaattcccacctatgagtgagaacatgaggtgtttggttttttgtccttgtgatagtttgctgagaatgatggtttccagcttcatccatgtccctacaaaggacatgaactcatccttttttatggcttcatagtattccatggtgtatatgtgccacattttcttaatccagcctatcactgatggacatttaggttggttccaagtctttgctgttgtgaatagtgccacaagaaacatacgtgtgcatgtgtctttatagcagcatggtttataaccctttgggtatatacccagtaatgggatggctgagtcaaatggtatttctagtcctagatcattgaggaatcaccacactatcttccacaatggttgaactagttcacagtcccatcaacagtgtaaaagtgttcctatttctccacatcctctccagcatctgttgtttcctgactttttagtgattgccattctaactggtgtaagatggtatctcattgtggttttgatttgcatttctctgatggccagtggtgatgaacattttttcatgtgtctgttggctgcataaatgtcttcttttgagaagtgtctgttcatacccttcacccgccttttgatggggttgtttgtttttttcttgtaaatttgtttgagttctttgtagattctggatattagccctttgtcagatgaatagattgcaaaaattttctcccattctgtaggttacctgttcactctgatggcagtttcttttgctgtgcagaagctctttgtttcttttgctgtgcagaagctctttagtttaattagatcccatttgtctattttggcttttgttgctgttgcttttggtgtttgagacatgaagtccttgcctatgctatgtcctgaatggtattgcctaggttttcttctagagttttatggttttaggtctaacatttaagtctttaatacatcttgaattaatttttgtataaggtgtaaggaagggatccagtttcagctttctacatatggctagtcagttttcctagcaccatttattaaatagggaatcctttccccattgcttgtttttctcaggtttgtcaaatatcagatggttgtagatgtgtggtattatttctgagggctctgttctattccattggtctatatctctgttttggtaccagaactatgctgttttggttactgtagccttgtagtatagtttgaagtcaggtaatgtgatgcttccagctttgttcttttggcttaggattgtcttggcaatgagggctcttttttggttccatatgaactttaaagtagttttttccaattctgtgaagaaagttattggtagcttgatggagatggcattgaatctgtaaattaccttgggcagtatggccattttcacgatattgattcttcctatccatgagcatggaatgttcttccatttgtttgtgtcctcttttattttgttgagcagtggtttgtagttctccttgaagaggtccttcacatcccttgtaagttggattcctaagtattttattctctttgaagcaattgtgaatgggagttcactcatgatttggctctctgtttgtctgttattggtatataagaatgcttgtggtttttgcacattgattttgtatcctgagactttgctgaagttgcttatcagcttaaggagattttgggctgagacaatggggttttctaaatatacaatcatgttatctgcaaacagggacaatttgacttcctcttttcctaattgaatacactttatttcttgctcctgcctgattgccctagccagaacttccaacactatgttgaatagcagtggtgagagagggcatccctgtcttgtgccaggtttcaaagggaatgcttccagtttttgcccattcagtatgatattggctgtgggtttgtcataaatacctcttattattttgagatatgtcctatcaatacctaatttattgagagtttttagcatgaagcgctgctgaattttgtcaaaggccttttctccatctactgagataaccatgtggtttttgtctttggttctgtttacgtgatggattacatttattgatttgcctatgttgaaccagccttgcatcctagggaatgaagcccacttgatcatggtagataagcttttcgatgtgctgctggattcggtttgccagtattttattgaggatttttgcatcgatgttcatcagggatattcgtctaaaattctctttttttgttgtgtctctgtcaggctttggtatcaggatggtgctggcctcataaaatgagttagggaggattccctcatcttatattgattggaatagtttcaggaggaatggtaccagctcctccttgtacctctggtagaattcagctgtgaatccatctggtgctagacttttttgggttgataggctattaattattgcctcaatttcagagcctgttattggtctattcagggattcaacttcttcctggtttagtcttgggagggtgtaagtgtccaggaatttatccatttcttctagattttctagtttatttgtgtagaggagtttatagtattctctgatggtagtttgtatttctatgggattggtggtgatatcccctttgtcattttttattgtgtctatttgattcttctctcttttcttctttattagtcttgctagcagtctatcaattttgttgatcttttcaaaacccagctcctggattcattgattttttgaagggttttttgtgtctctctatctccttcatttctgctctgatcttagttatttcttgccttctgctagcttttgaatgtgtttgttcttgcttctctagttcttttagttgcaatgttagagtgtcaattttagatctttcctgctttcccttgtgggcatttagtgctataaatttccctctacacactgctttgaatgtgtcccagagatcctggtatattgtgtctttgttctcattggtttcaaagaacatctttatttctgccttcattttgttatgtacccagtagtcattcaggaatagcttgttcagtttccatgtagttgagtggttttgagtgagtttcttaatcctgagttctagtttgattgcactgtggtctgagagacagtttgttataatttctgttcttttacatttgctgaggagtgctttacttctaactatgtggtcaatttttgaataagtgtgatgtggtgctgagaagaatgtatattctgttgatttggggtggagagttctgtagatgtctattaggtctgcttggtgcagagctgagttcaattcctggatatccttgttaattttctgtctcattgatctgtctaatgttgacagtggggtgttaaaatctcccagtattattgtgtgggagtctaagtctctttgtaagtctctaaggacttgctttatgaatctgggtgctcctgtattgggtgcatatatatttaggatagttagctcttcttgttgaattgatcccttcaccattatgtaatcgccttctttgtctcttttgatttttgttggtttaaagtctgtcttatcagagactaggactgcaacccctgcctttttttgttttccatttgcttggtagatcttcctccatccctttattttgagcctatgtttgtctctgcacgtgagacgggtctcctgaatacagcacactaatgggtcttgactctttatccaatttgctagtctgtgtcttttaattggagcatttagcccatttacattcaaagttaatattgttgtgtgaatttgatcttgtcactatgatgttagctggttattttgctcgttagttgatgcagtttcttcctagcattgatggtctttacaatttggcatgtttttgcagtggctggtaccggttgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagtatgttgaatattggtccccactctcttctggcttgtagagtttctgccaagagatccgctgttagtctgatgggcttccctttcagggtaacccaacatttctctctggctgcccttaacattttttccttcatttcaactttggtgactctgacaattacgtgtcttggagttgctcttctcgaggagtatctttgtggcattctctgtatttcctgaatttgaatgttggcctgccttgctaggttggggaagttctcctagataataacctgcagagtgttttccagcttggttccattctcctcatcattttcaggtacaccaatcagacttagatttggtcttttcaaatagtcccatatttcttagaggctttgtttgtttctttttactctgttttctctaaacttctctttcacttcatttcattcatttgatcttcaatcactgatactctttcttccagttgatcaaatcggctactgaagcttgtgcattcagcacgtagttctcgtgccatggttttcagctccatcaggtcatttgaggacttctctacactggttattctagttagccattcgtccaatcttttttcaaggtttttagcttctttgcgctgggttcgcacttcctcctttagctcggagaagtttgatcatctgaagccttctactctcaactcatcaaagtcattctccatccagcattgttccgttgctggagaggagctgtgttcctttggagggggagaggagctctgatttttagaattttcagcttttctgctctgttttttccccatctttgtggttttatctacctttggtctttgatgatggtgatgtacagatggggttttggtgtggatgtcctttctgtttgttagttttccttctaacagtcaggaccttcagatgcatgtctgttggagtttgctggatgtccactccagaccctgtttgcctgggtatcagcagcggaggctgcagaagagcaaatactgctgaagagcaaatgttgctgcctgatcattcctctggaagcttcatctcagaggggtacccggccatgtgaggtgccagtcttcccctactgggggtgcctcccagttaggctactcagaggtcagggacccacttgaggaggcagtctgtccgttctcagatctcaaactccatgctgggagaaccaccactctcttcaaagctgtcagacagggacatttaagtctgcagagg

SEQ ID NO: 12713 - DNA, 11093 bp, Homo sapiens
agaaggcctcttttttttattattatactttaagttttagggtacatgtgcacaatgtgcaggttagttacatatgtatacatgtgacatgctggtgcactgcacccactaactcatcatctagcattaggtatatctcccaatgctatccctcccccctcccccaccccacaacagtccccagagtgtgatgttccccttcctgtgtccatgtgttctcattgttcaattcccacctatgagtgagaatatgcggtgtttggttttttgttcttgcgatagcttactgagaatgatgatttccaatttcatccatgtccctacaaaggacatgaactcatcattttttatggctgcatagtattccatggtgtatatgtgccacattttcttcatccagtctatcattgttggacatttgggttggttccaagtctttactattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatgctctccagcatctgttgtttcctgacttcttaatgattgccattctaactggtgtgagatggtatctcattgtggttttgatttgcatttctctgatggccagtgatagtgagcattttttcatgtgctttttggctgcataaatgtcttcttttgagaattgtctgttcacgtccttcgcccactttttgatggggttgtttgtttttttcttgtaaatttgtttgagttcattgtagattctggatattagcctgagaaggcctcttaatagaaactgattttcccccatatccctacccccaacttcctccttcttgtttcctgaacagttgctgtgaagactagaaatgcacgagccattttgcatcatgaaatgaccttaaaagggcaattcacatgaagaatggtggaggagaaagattaaagagatacccagatagtgagcatagtacctgataggtggaatttttttcaactcatgttgtcctccctatctcccacttctagtagtttgcagtgtctatttttcccatatttatgtctgtgtgtgctcaacgtttagctcctatttataagtgagaacctgtggtatttagctttgtgtttctttgttaatttattcaggatgatggcccctaactgcatccatgttgctgcaaaagacattattccattctttttatgcgtgcatagtgttccatggtgtatatgtgtgtggtatgaatacactatagaactttgacattaaaataaacacttttccatcaaaagaccttataaaggaaataaaaagacaagccataagcagagctatttgaaacacttagaattgacaaaggatttagtacccagattatgtaagtaaatcctaaaaatataatagaaaaaaagacaaatgactcaacagaaaattagaaaatattattgaactggttttcaaagaagagttaatacgaatggtatcaaatctatgaaatgattgtaatctaataatcagaaaaatgcaaattaaaactataatgaaatataattttgcttgacatgattggcagaaatgtttaagtctgacaataccaagtatttgaaggctgtagtacaagttttattatttttgagattgtatattttcactaccatctaggtaattaggcattatctattacattttaagatgtacacaattgattacccagaaattttctctcacatgaaaaacccaaaacatttacatgtatattttaggagacaagtatgcaaatactcatagcagtttttttttttaagtaaaatactacaaataccccaaatgctacactataaatggccatcagcagaagaatgggtaaataagttgtggtatacaatatggattggctgtgttcccacctaaataccttgaattataataattcctgtgtgtcaagggtcagaggggtggggcaggtggagataattgaatcatgggggcagtttcccccatactgttctcatggtagtgaataagtgtcatgagatctgatggttttataactgggagttcccctgcacaagctctctttcctgccaccatgtaagacatgtttttgcttctcccttgtcttccgccatgatcatgagggctccccagccatgtggagctgtgagtccattaaacctcttttctttataaattacccagtgttgggtatgtctttattagaagagtgagaacagactaatacagtatatttatatgaaagaataatgcacagcagtgaaatgagtgaactacaactacacagattaacatggaaaaatctataataaaattttaaccaaaagaaaaagtgtcaaaatatgacataaatatgattctattaaagttcaaaaatgtgcaaagcaaattaataaattttaattacacttatgtggtaaacaataaagaaatgcatggaaaagataagtacaatgatctgaatagttttcttctctgtgtatgggataaggagtggctaaggtcacacagaatctgaaaactggtaatggtccttgccttaacccacgctgtggataccaaggttttattaattattattatttacatttttaatttttattctcctgtatgtgtgaaatatttcatattaaaaagcaaaaacaaactacaacaaaaaatagtaagaattactcaggacagactatctagttctatggacatgattattttaagggagccagtattatgaaactgttataacctcttctgggtaaaaatgatggcttgtgataccattcaatgcaaccttacttttctcattgagtacagtgagaatcagggttgtatttccaaccctcttcccccatcagattttctaataaaaacattaagataataaggcagtgtaatctctagacaggctgatttctcacagaaattttcaaagcatggtgtgtgatatggcttggctgtgtccccacccaaatctcatcttgatttgtagctcccataattcccatatgttgtggaaggaacccagtggaagataattgaatcatggagggtttcccctgtactgttatcataatagtaaataagtctcataaaatctgatattttctatagggtttccccttacattttgttctcattcattctttctttcttttattaaaattctactttaagttctgggagacatgtgcagaacgtgcaggtttgttacacaggtatacatgtgccatggtggttggcttcacccatcaacctgtcatctacattagtatttctcctaatgctatccctccctttgccccccactccctgacaggccccagtgtgtgatgttccctttcctgtgcccatatgttatcattgttcaactcccacttatgagtgtgaacatgtgatgtttggttttctgttcctgtgttagtttgctgagaatgatggtttccagcttcatccatgtccctgcaaagggcatgaactcattcttctttatggctgcatagtattctgtggtgtatatgtgccacattttctttatccagtctaatattgatgggcatttgggttggttccaagtctttgctattgtgaatagtgccacaataaacacaggtgtacatgtgtctttatagtagaatgatttataaccctttgggtatatacccagtaatgggactgctggctgaaaagatatttctagttttagatctttgaggaatgaccacactgtcttccacaatggttgaactaatttacactcctaccaacagtgtaagagcattcctatttctccacatcctctccagcatctgctgtttcctggcttttgaatgatcgccattctaactagtgtgagatggtaactcactgtggttttgattggcatttctctaatgatcagtgacgatgaccttttttcatatgtttgttggccacataaatatcttcttttgaaaagtgtccattcatatccttcacccactttttgatggtgttgcttgtttttttttttttttttttgcaaatttatttatgttccttatagattctggatattagccctttggcacatggagagattgcaaaaattttctccccttctgtaggttgcctcttcactctgatgatagtttcttttgctgtgcagaagctctttagtttaattagatcctatttgtcaattttggcttttgttgccattgcttttggtattttagtcatgaagtcctttcccattcctatgtactgaatggtattgcctaggttttcttctagggtttttatggttttaggtgttatgtttaaatctttaatccaccttgagttaatttttgtataaggtgtaaggaagggtccagtttcagttttctgcatattactagccagttttcccaacaccttttattaaatagggaatcctttccccgttgcttgtttttgtgaggtttgtcaaaaaaagatcagatggttgtagatgtgtggtgttatttctgaggcctctgttctgttccattggtctatatatctcttttggtaccagcaccgtgctgtttggttaactgtagccttgtagcatagattgaagtctggtagagtgatgtctccagctttgttctttttgcttaggattgtcttggctatatgggctctttgttggttccatatgaaatttaaaatagttttttctaattccgtgaagaaagtcaatggtagcttcataggaatagcattgaatctataaattactttgagcagtatggccattttcatgacatttattcttcctatccatgagcatggatggtttttccatttgtttgtgtcctctcttatttccttgagcagtggtttatagttcttgacaacgtcctttacatcccttgtaaattgtattcctaggtattttattctctttgtaacaattgtgaatgggagttcactcatgatttggctctctgtttgtctattttttttattatactttaagttttagggtacatgtgcacaatgtgcaggttagttacatatgtatacatgtgccatgctggtgcgctgcacccactaactcgtcatctagcattaggtatatctcccaatgctatccctccccactccccccaccccaccacagtccccagagtctgatattccccttcctgtgtccacctatgcggtgtttggttttttgttcttgagatagtttactgagaatgatgatttccaatttcatccatgtccctacaaaggacatgaactcataattttttatggctgcatagtattccatggtgtatatgtgccacattttcttcatccagtctatcattgttggacatttgggttggttccaagtctttgctattgtgaataatgccgcaataaacatacgtgtgcatgtgtctttatagcagcatgatttatagtcctttgggaatatacccagtaatgggatggctgtgtcaaatggtatttctagttctagatccctgaggaatcgccacactgacttccacaatggttgaactagtttacagtcccaccaacagtgtaaaagtgttcctatttctccactcctctccagcacctgttgtttcctgactttttaatgattgccattctaactggtgtgagatggtatctcattgtggttttgatttgcatttctctgacggccagtgatgatgagcattttttcatgtgttttttggctgcataaatgtcttcttttgagaagtgtctcttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccatcgcttttggtgttttagacatgaagtccttgcccatgcctatgtcctcaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtctttctcaggtttgtcaaagatcagatagttgtagatatgcggcgttatttctgagggctctgttccattccattgatctatatctctgtttcggtaccagtaccatgctgttttggttactgtagccttgtagtatagtttgaagtcagatagtgtgatgcctccaggtttgttcttttggctgaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtgctttgtagttctccttgaagaggtccttcacattccttgtaagttggattcctaggtattttattctctttgaagaaattgtgaatgggagttcactcaagatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatgtaaaaacagggacaatttgacttcctcttttcctaattgaataccctgtatttccttctcctgcctaattgccctggcctgaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcgttttgccagtattttattgaggatttttgcatcaacgttcatcaaggatattggtctaaaaatctcttttttggttgtgtctctgcccggctttggtatcagaatgatgctggcctcataaaatgagttagggaggattccctctttttctattgattggaatagtttcagaaggaatggtaccagttcctccttttacctctgatagaattcggctgtgaatccatctggtcctggactctttttggttggtaaactattgattattgccacaatttcagatcctgttattggtctattcagagattcaacttcttcctggtttagtgttgggagagtgtatgtgtcgaggaatttatccattttttctagattttccagtttatttgcgtagaggtgtttgtagtattccctgatggtagtttgtatttctgtgggatcggtggtgatatcccctttatcattttttattacgtctatttgattcttctctctttttttctttattagtcttgctagcggtctatcaattttgttgatcctttcaaaaaaccagctcctgtattcatttttttgaagggttttttgtgtctctatttccttcagttctgctctgattttagttatttcttgccttctgctagcttttgaatgtgtttgctcttgcttttctagttcttttaattgtgttgttagggtgtcaattttggatctttcctgctttctcttgtgggcatttagtgctataaatttccctctacaaactgctttgaatgtgtcccagagattttggtatgttgtgtctttgttctcgttggtttcaaagaacatctttatttctgccttcatttcgttatgtatccagtagtcattcaggagcaggttgttcagtttccatgtagttgagcggttttgagtgagattcctaatcctgagttctagtttgattgcactatggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttgttttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccaatctgtgtcttttaattgaagcatttagtccatttacatttaaagttaatattgttatgtgtgaacttgatcctgtcattatgatgttagctggtgattttgctcgttagttgatgcagtttcttcctagtctcgatggtctttacattttggcatgattttgcagcggctggtaccagttgttcctttccatgtttagcgcttccttcaggagctcttctagggcaggcctggtggtgacaaaatctctcagcatttgcttgtctgtaaagtattttatttctccttcacttatgaagcttagtttggctggatatgaaattctgggttgaaaattcttttctttaagaatgttgagtattggcccccactctcttctggcttgtagggtttctgccgagagatccactgttagtctgatgggcttccctttgagggtaacctgacctttctctctggctgcccttaacattgtttccttcatttcaactttggtgaatctgacaattatgtgtcttggagttgctcttctcgaggagtatctttgtggtgttctctgtatttcctgaatctgaacattggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcatttttctctaaacttcccttctctcttcatttcattcatttcatcttccattgctgataccctttcttccagttgatcgcattggctcctgaggcttctgcattcttcacgtagttctcgagccttggttttcagctccatcacctcctttaagcatttctctgtattggttattctagttatacattcttctaaatttttttcaaagttttcaatttctttgcctttggtttgaatgtcctcccatagctcagagtaatttgatcgtctgaagccttcttctctcagctcgtcgaagtcattctccatccagctttcttccgttgctggtgaggaactgcgttcctttggaggaggagaggcgctctgctttttagagtttccagtttttctgttctgttttttccccatctttgtggttttatctacttttggtcgttgctgatggtgatgtacagatgggtttttggtgtggatgtcctttctgtttgttagttttccttctaacagacaggaccctcagctgcaggtctgttggaataccctgccgtctgaggtgtcagtgtgcctctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctttttgtctgtgccctgcccccagaggtggagcctacagaggcaggcaggcgtccttgaactgtggtgggctccacccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcggggtataatctcgtggtgtgccgtttttaagccggtcctaaaagcgcaatattcgggtgggagtgacccgattttccaggtacgtccgtcacccctttctttgactcggaaagggaactccctgatcccttgcgcttcccaagtgaggcaaagcctcgccctgcttcagctggcgcaccgtgtgcacacccactgacctgcgcccactgtctggcactccctagtgagatgaacctggtacctcagatggaaatgcagaaatcacccgtcttctgcgtcgctcacgctgggagctgtagaccagagctgttcctatttggccatcttggctcctgccccct

SEQ ID NO: 12714 - DNA, 4923 bp, Homo sapiens
ttattcttttttttttttctttatactttaagttctaggatacatgtgcacaacgtgcaggtttgttacatatgtctacatgtgccatgttggtgtgctgcacccattaactcatcatttacattaggtatatctcctaatgctatccctcccctctgcctgccccacgacaggccccagtgtgtgatgtttcccttcctgtgtccaagtgttctcattgttcaattcccacctatgagtgagaacatgcagtgtttggttttttgtccttgaaatagtttgctgaaaatgatggtttccagattcatccatgtccctacaaaggacatgaactcatccttttttatggctgcatagtattccatggtgtatatgtgccacattttcttaatctagtctgtcactgatgggcatttgggttggttccaagtctttgctattgtgaatagtgccccaataaacatacatgtgcatgtgtctttatagcagcatgatttataatcctttgggtatatacccagtaatgggatggctgggtcaaatggtatttctagtactagatccttgaggaatcgccacactgttttccacaatggttgaactagtttacagtcccaccaacagtgtaaaagtgttcctatttctccacatcctctctagcacctgttgtttcctgactttttaatgatcaccattctaactggtgtgagatggtatctcattgtggttttgatttgcatttctctgatggccagtgatgatgagcattttttcatgtgtctgttggctgcataaatgtcttgttttgagaagtgtctgttcatctccttcgcccactttgtgatggggttgtttgtttttttcttgtaaatttgtttgggttctttgtagattctgggatattagtcctttgtcagatgagtagattgcaaaaattttctccaattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtatttcctaggttttcttctagggtttttatggttttaggtctgacatttgagtctttgatccatcttgagttaatttttgtataaggtgtaaggaaggaatctagtttcagctttctacatgtggctagccagttttcccagcaccatgtattaaatagggaatcctttccccatttcttgtttttgtcaggtttgtcaaagatcacatggttgtagatgtgtggtattatttctgagggctctgttctgttccattggtctatatctctgttttggtaccagtaccatgctgttttggttactgtagccttgtagtatagtttgaactcaggtaacgtgatgcctccagctttgttcttttggcttaggattgtattggcaatgtgggctcttttttggttccatatgaactttaaagtagttttttccaattctgtgaagaaagtcattggtagcttgatggggatggcattgaatctataagttaccttaggcagtatggccattttcacaatattgattcttcctgtgcatgagcatgaaatgttcttccatttgtttgtgtcctcttttatttcgttgagcagtggtttgtagttctccttgaagaagtccttcacatcccttgtaagttggattcctaggtattttcttctctttgaagcaattgtgaatgggagttcactcatgatttggctctctgtttgtctattattggtgtataagaatgcttgtgatttttgcacattgatttttatcctgagactttgctgaagttgcttatcagcttaaggagattttgggctgagacgatggggttttctaaatatacaattacgtcatctgcaaacagggacaatttgacttcctcttttcctagttgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccagcaataccgaatttattgagagtttttagtatgaagggctgtttaatttttcaaaggccttttctgcatcttttgagataatcatgtggtttttgtctttggttctgtttatatgctggattatgtttattgatttgtgtatgttgaaccagccttgcatcccagggatgaagcccacttgatcatggtggataagctttttgatgtgcttctggattcggtttgccagtattttactgaggatttttgcataaatgttcatcagggatattggtctaaaattctcttttttcgttgtatctctgccaggctttggtatcaggataatgctggcctcataaaatgagttagggaggattccctctttttctattgattggaatagtttcagaaggaatggcagcagctcctccttgtgcctctagtagagggtagagctgtgaatccgtctggtcctggactttttttggctggtaggctattaattattgcctcaatttcagagcctgttattggtctattcagggattcaacttcttcctggtttagtgttgggagtgtgtatgtatccaggaatttatccatttcttctagattttctagtttatttgtgtagaggtgtttatagtattctctgatggtagtttgtatttctgtgggatcagtggtgatatcccctttatcattttttattgtgtctatttgattcttctctcttttcttctttattagtcttggtagcggtctatcaattttgttgatcttttcaaaaaaccagctcctggattcattgattttttgaagagttttttgtgtctctatctccttcagttctgatctgatcttagttatttcttgccttctgctggcttttaaatgtgtttgctcttgcttctctagttcttttaattgtgatgttagggtgtcaatttaaatctttcctgctttctcttgtgggcatttagtgttataaatttccctttacacactgctttaaacgtgtcccagagattctggtatgttgtgtctttgttctcattggtttcaaagaacatctttctgccttcatttaacaaaatgtacccagtagtcattcaggagcaggttgttcagtttccatgtagttgagtggttttgagtgagtttcttaatcctgagttctagtttgattgcgctgtggtctgagagacagtttgttataatttctgttcttttatatttgctgaggagtgctttacttccaactatgtggtcagttttggaataagtgcgatatggtgctgagaagaatgtatattctgttgatttggggtggagagttctgtagatgtctattaggtctgtttggtgcagagctgagttcagttcctgggtatccttgttaactttctgtctcgttgatctgtctaatgttgacagtggggtgttaaggtctcccattattattgtgtgggagtctaagtctctttgtaggtctctaaggagttgctttatgaatctgggtgctcctgtattgggtgcatatatatttaggatagttagctcttcttgttgaattgatccctttaccattatataatggccttctttgtctcttttggtctttgttggtttaaagtctgttttatcagagattaggtgtgcaacccctgcctttttttgttttctatttgcttggtagatcttcctccatccctttattttgagcctatgtgtgtctctgcatgtgagatggggctcctgaatacaacacactgttgggtcttgactctttatccaatttgccagtccgtgtcttttaattggagcatttagcccatttacatttaaggttaatattgttatgtgtgaatttgatcctgtcattatgacattagctggttattttgctccttagttgatgcagtttcttcctaccatcaatggtctttacaatttggcatgtttttgcagtggctggtaccagttgttcctttccatgtttagtgcttccttcaggagctcttttagggcaggcctggtggtgacaaaatctctcagcatttgcttatctgtaaagtattttatttctccttcacttatgaagcttaatttggctgtatatgaaattctgggttgaaaattcttttctttaagaatgttgaacattgccccccactctcttctggcttgtaaagtttctgcggagagatcagctgttagtctgatgggcttccctttgtgggtaaccagacctttctctctggctgcccttaacattttttccttcatttccactgtggtgaatctgacaattatgtcttggagttgctcttcttgaggagtatctttgtggcattctctgtatttcctgaatttgaacgttggcctgccttgctaggttggggatgttctcctggataatatcctgcagagtgttttccagcttggttccattctccctgtcactttcaggtacaccaatcagacgtagatttggtcttttcacatagccccatatttcttggagactttgttcgtttcttttactctattttctctaaacttctcttctcacttcatttcattcatttgatcttcagtcactgataccctttcttccagttgatcgaatcggctactgaagcttgtgcattcatcatgtagttcttgtgccacagtattcagctccatcaggtcatttaaggacttctctatgctggttattctagttagccatttgtctaatcttttttcaaggtt

SEQ ID NO: 12715 - DNA, 6046 bp, Homo sapiens
tttattttattttatttttttttttatattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctctagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtttaatgtttaaatctttaatccatcttgaattgatttttgtataaggtgtaaggaagggatccagtttcagctttctacatatggatagccagttttcccagcaccatttattaaatagggaatcctttccccattgcttgtttttctcaggtttgtcaaagatcagatagttgtagatatgcggcattatttctgagggctgtgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttattggtgtataagaatgcctgtgatttttgtacattgattttgtatcctgagactttgctgaagttgcttatcagcttaaggagattttgggctgagacagtggggttttctagataaacaaacatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattggtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgcaataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgttgaggagagctttacttccaactatgtggtcaattttggaataggtgtggtgtggtgctgaaaaaaatgtatattctgttgatttggggtggaaagttctgtagatgtctattagggctgcttggtgcagagctgagttcaattcctgggtatccttgttgactttctgtctcattgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccatgatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgaccattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctcttagctcgtcaaagtcattctccatccagctttgttctgttgctggtgaggaactgcgttcctttggaggaggagagacgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgtagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagtaatcacccgtcttctgcgtcgctcacgctgggagctgtagaccggagctgttcctattcggccatcttggctcctccccca

SEQ ID NO: 12716 - DNA, 5497 bp, Homo sapiens
ttttttctttctttctttcttttttattattattatactttaagttttagggtacatgtgcacaatgtgcaggtttgttacatatgtatacatgtgccgtgttagtgtgctgcacccattaactcatcatttagcattaagtatgtctcctaatgctatccctaccccctccccccaccccacaacagtccccggagtgtgatgttcctcttcctgtgtccaagtgttctcattgttcaattcccacctatgagtgagaacatgtggtgtttggttttttgtccttgcgatactttgctgagaatgatggtttccagtttcatccatgtccctacaaaggacatgaactcatccttttttatggctgcatagtattccatggtgtatatgtgccacattttcttaatccagtctattgttcttggacatttgggttggttccaagtctttgctattgtgaatagtgccgcaataaacatacgtgtgcatgtgtctttatagcagcatgatttataatcctttgggtatacacccagtaatgggatgcctgggtcaaatggtattcctagttctagatcactgaggaattgccacactgacttccacaatggttgaactagtttacagtcccaccaacagtgtaaaagtgttcctatttctccacatcctctccagcacctgttgtttcctgactttttaatgatggccattctaactggtgtaagatggtatctcattgtggttttgatttgcatttctctgatggccagtgatgatgagcattttttcatgtgttttttggctgcataaatgtcttcttttgagaagtgtctgttcatatccttccacccactttttgatggggttgtttgtttttttcttgtaaatttgtttgagttcattgtagattcttcatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccctgcccatgcctatgtcctgaatggtattgcctaggttttcttctagggtttttatggttttaggtctaacatttaagtctttaatccatcttgaattaaattttgtctaaggtgaaaggaagggatccagtttcagctttctacatatggctagccagttttcccagcaccatttattaaatagggaatcctttccccatttcttgtttttgtcaggtttgtcaaagatcagatggttgtagatacatggtattatttctgagggctctgttctgttccattgatctatatttctgttttggtaccagtaccatgctgttttggttactgtagccttgtagtatagtttgaagtcaggtggcgtgatgcctctggctttgttcttatggcttaggattgacttggccatgtgggctcttttttggttccatatgaactttaaagtagttttttccaattatgtgaagaaagtcattggtagcttgatggggatggcattgaatctataaattaccttgggcagtatggccattttcacgatattgattcttcgtacccatgagcatggaatgttcttccatttgtttgtatcctcttttatttcattgagcagtggtttgtagttctccttgaagaggtccttcatatcccttgtaagttggattcctaggtattttattctctttgaagcaattgtgaatgggagttcactcatgatttggctctctgtttgtctgttattggtgtataagaatgcttgtgattattgtatgttgattttgtatcctgagactttgctgaagttgcttatcagcttaaggagattttgggctgagacaatggggtgttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcgagttctcaaagggaatgcttccagtttttgcccattcagtatgatactggctgtgggtttgtcatagatagctcttattattttgagatacgtcccatcaatacgtaatttattgagagtttttagcatgaagggttgttgaattttgtcaaaggtcttttctgcatctattgagataatcatgtggtttttgcctttggttctgtttatatgctggattatatttattgatttgcatatattgaaccagccttgcatcccagggatgaagcccacttgatcatggtggataagctttttgatgtgctgctggattcagtttgccagaattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaagaaatggtaccagctcctccttgtacctttggtagaattcggctgtgaatccatctggtcctggactctttttggttgataagctattgatcattgccacaatttcagagcctgttatttgtctattcagagattcaaattcttcctggtttagtcttgggagggtatatgtgttgaggaatttatccatttcttctagattttctagtttatttgcgtagaggtgtttgtattattctctgatggtagcttgtatttctgtgggatcggtggtgatatcccgtttttcattttttattgcgtctatttgattcttctctcttttcttctttattagtcttgttagcagtctatcgattttgttgatcttttcaaaaaaccagttgctggattcattaattttttgaagggttttttgtgtctcaatttccttcagttctgctctgattttagttatttcttgccttctgctagcttttgaatgtgattgctcttgcttttctatttcttttaattgtgacgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgcacccagtagtcattcaggagcaggttgctcagtttccaggtagttcagcagttttgagtgagtttcttagtcctgagttctagtttgattgcactgtggtctgagagacagtttgttataatttctgttcttttacatttgctgaggagtgctttacttccaactatgtggtcaattttggaacaggtgtgatgtggtgctgaaaaaaatgtatattctgttgatttggggtggagagttctgtagatgtctattaggtccacttggtgcagagctgagttcaatttctggatatcctttttaactttctgtctcgttgatctgtctaatgttgacagtgaggtgttaaaatctcccattattattgtgttggagtctaagtctctttgtaggtcactcaggacttgctttgtgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttcttttgttttccgtttgcgtggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaagttaatattgttatgtgtgtatttggtcttgtcattatgatgttagctggttattttgctcgttagttgatgcagtttcttcctagccttgatggtctttacattttggcatgtttttgcagtggctggtaccggttgttcctttccatgtttagtgcttccttcaggagctcttttagggcaggcctggtggtgacaaaatctctcagcatttgcttgtctgtaaagtattttacttctccttcacttgtgaagcttagtttggctggatatgaaattctgggtggaaaattcttttctttaagaatgttgaatattggcccccactctcttctggcttgtagagtttctgctgagagatccactgttagtttgatgggcttgcctttgtgggtaacccaacctttctctctggctgcccttaacgttttttccttcatttcaactttggtgaatctgacaattatgcgtcttggagctgctcttctcaaggagtatctttgtggcattctctgtatttcctgagtctgaatgttggcctgccttgctagattggggaagtgctcctggttaatagcctgcagaatgttttccaacttggttccattctccctgtcactttcaggtacaccaatcagacgtagatttggtcttttcacatagtcccatatttcttggggctttgttcatttctttttattcctttttctctaaacttcccgtctcgtttcatttcattcatttcatcttccatcactgataccctttcttccagttgattgaatcggctcctgaggcttctgcattcttcacgtagttctcgagccttggctttcagctccatcagctcctttaaggacttctctgctttggttattctagttatccattcgtctaattttttttcacagtttttaacttctttgccattggtttgaatttcctcctgtagcttggagtactttgattgtctgaagccttctttttcagctcatcaaagtccttctccatccagctttgttccattgctggtgaggagctgcgttcctttggaggaggagacgtgctctgctttttagagtttccagtttttctgctctgttttttcccaatctttgtggttttatctacttttggtctctgatgatggtgacgtacagaagggtttttggtgtggatgtcctttctgtttattagttttccttcgaacagacaggaccctcagctgcaggtcttttggagtttgctagaggtccactccagactctgtttgcctgggtatcagcagcggtgactgcagaacagcggtggctgtagaacagcggatcttggtgaaccacaaatgctgctgcctaatcgttcctctggaagttttgtctcagaggggtacccggccatgtgaggtgtctgtctacccctactggggggtgcctcccagttatgctgctcaggggtcaaggacccact

SEQ ID NO: 12717 - DNA, 6068 bp, Homo sapiens
  misc_feature (2497)..(2497): n equals a,t,g, or c
ttttttttttttttttttgccaattaaggaatttatttttttttttttatactttaagttttagggtacatgtgcacattgtgcaggttagttacatatgtataaatgtgccatgctggtgcgctgcacccactaactcgtcatctagcattaggtatatctcccaatgccacccctcccccctccccccaccccaccacagtccccagagtgtgatattccccttcctgtgaccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggttgcctgttcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtctaacgtttaaatctttaattcatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcagacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaattctcntttttggttgtgtctctgcccggctttggtatcagaatgatgctggcctcataaaatgagttagggaggattccctcttttctattgattggaatagtatcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaacatatattctgttgatttggggtggagagttctgtagatgtctattaggtccgcttggtgcagagatgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctcaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctccggggtcagggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagacgcaggcaggcctccttgagctgtggtgggctccacccagttcgagcttcccggctgctttgtttacctaagcaagcctgggcaatggcgggctcccctcccccagccttgctgccgccttgcagtttgatctcagactgctgtgctagcaatcagcgagattccgtgggcgtaggaccctccaagccaggtgtgggatatagtctcgtggtgcgccgttttttaagccggtctgaaaagcgcagtattcgggtgggagtgacccgattttccaggtgcatccgtcacccctttctttgactcggaaagggaactccctgaccccttgcgcttcccaggtaaggcaatgcctcgccctgcttcggctcgcgcacggtgcgcacacccactggcctgcgcccactgtctggcactccctagtgagatgaacctggtacctcagatggaaatgcagaaatcacccgtcttctgcgtcgctcacgctgggagctgtagaccggagctgttcctattcggccatcttggctcctcccccaacatat

SEQ ID NO: 12718 - DNA, 6028 bp, Homo sapiens
ttttgttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttaatagcagacaaatgaatttatacttcatttgggtaatacccagtaatgggatggctgggtcaaatggatttctagttctagatcctgaggaatcaccacactgacttccacatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacgtaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtattgctgtgggatcggtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcacagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccatgtttagcgcttccttcaggagctcttttagggcaggcctggtggtgacaaaatctctcatcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcactctgcgttttagagtttccagtttttctgttctgttttttccccatctttgtggtttatctacttttggtctttgatgatggtgatgtacagatgggttttcggtgtagatgtcctttctggttgttagttttccttctaacagacaggaccctcagctggaggtctgttggaataccctgccgtgtgaggtgtcagtgtgcccctgctggggggtgcctcccaattaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggctatggcgggcgcccctcccccagcctcgttgccgcctggcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacctggtacctcagatggaaatgcagaaatcacccgtcttctgcgtcgctcacgctgggagctgtagaccggagctccac

SEQ ID NO: 12719 - DNA, 5229 bp, Homo sapiens
ttatttttttttttaattttattattattatactttaagttttagggtacatgtgcacaatgtgcaggtttgttacatatgtatacatgtgccatgttggtgtgctgtacccattaactcgtcatttagcattaggtatatctgctaatgctatccctcccccgctcccccaaccccacaacagtctccggagtgtgatgttccccttcctgtgtccatgtgttctcactgttcaattcccacctatgagtgagaacatgcagcgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttaggttggttccaagtctttgctattgtgaatagtgctgctataaacatatgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgatttttggctgcataaatgtcttcttttgagaagtgtctgttcatgtcgttcacccactttttgatggggttgtttgtttttttcttgtaaatttgtttgagttcattgtagattctggatattagccctttgtcagatgagtaggttgcaaaaattttctcgcattctgtaggttgcctgttcactctgatggtactttcttttgctgtgcagaagctctttagtttaattagatcccatttgtcaattttggcttttgttgccattgcttttggtaattgaagtccttgcccatgcctatgtcctgaatggtaatgcctaggttttcttctaggatttttatggttttaggtctaacatgtaagtctttaatccatcttgaattaatttttgtatgaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctcttttctgttccattgatctatatctctgttttggtaccagtaccatgctgttttggttactgtagccttgtagtatagtttgaagtcaggtagtgtgatgcctccagctttgttcttttggcttaggattgacttggtgatgtgggctcttttttggttccatatgaactttaaagtagttttttccaatctgtgaagaaagtcattggtagcttgatggggatggcattgaatctataaattaccttgggcagtatggccattttcacgatattgattcttcctacccatgagcatggaatgttcttccatttgtttgtatctgttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttccttatcagtttaaggaggttttgggctgagacaatggggttttctagaggtacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtaccagttttcaaagggaatgcttccagtttttgcccattcagtatgatattggctgtgagtgtgtcatagatagctcttattattttgagataggtcctatcaatacctaatttattgagagtttttagcatgaaggttgttgaattttgtcaaaggccttttctgcatgtattgagataatcatgtggtttttgtctttggttctgtttatatgctggattacattcattgatttgcatatgttgaaccagccttgcatcccagggatgaagcccagttgatcatggtggataagctttttgttgtgctgctggattcagtttgccagtattttattgaggatttttgcatcaatgttcatcaaggatattggtctaaaattctcttttttggttgtgtctctgtcaggctttggtatcaggatgatgctggcctcataaaatgagttagggaggattctctctttttctattgattggaatagtttcagaaggaatggtaccagctcctccttgtacctctggtagaattcggctgtgaattcatctggacctggactttttttggttggtaagcaattgattattgccacaatttcagagcctgttattggtctattcatagattcaacttcttcctggtttagtcttgggagggtgtatgtgtccaggaatttatccatttcttctagattttctagtttatttgcgtagaggtgtttgtagtattctctgatggtagtttgtatttctgtgggatcggtggtgataccccctttatcattttttattgcgtctatttgattcttctctcttttcttctttattagtcttgctagcggtctatcaattttgttgatcttttcaaaaaaccagctcctggattcattgatttttttgaagggttttttgtgtttctatttccttcatttctgctctgattttagttatttcttgccttctgctagcttttgaatgtgtttgctcttgctttcctagttcttttaattgtgacgttagggtgtcaattttggatctttcctgctttctcttgtgggcatttagtgctataaatttccctctacacactgctttgaatgtgtcccagagattctggtatgttgtgtctttgtttttgttggtttcaaagaacatctttatttctgccttcatttcgttatatacccagtagtcattcaggagcaggttgttcagtttccatgtagttgagcggttttgagtgagtttcttaatcctgagttctagtttgattgcactgtggtctgagagacagtttgttataatttctgttcttttacgtttgctgaggagtgttttacttccaagtatgtggtcaattttggaataggtgtggtgtggtgctgaaaaaaatgtatattctgttgatttggggtagagagttctgtagatgtctgttagatctgcttggtgcagagctgagttcaattcctgggtatccttgttaactttctgtctcattgatctgtctaatgttgacaatggggtgttaaagtctcccattgttattgtgtgggagtgtaagtctctttgtaggtcactaaggacttgctttatgaatctaggtgctcctgtattgggtgcgtatatatttaggatagttagctcttcttgttgaattgatccctttaccattatataatggccttctttgtctcttttgatctttcttggttgaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactccttatccaatttgtcagtctgtgtcttttaattggagcatttagcccatttacatttaaagttaatattgttatgtgtgaatttggtcctgtcattatgatgttagctggtgattttgctcgttagttgatgcagtttcttcctagccttgatggtctttacattttggtatgtttttgcagtggctggtaccagttgttcctttccatgtttggtgcttccttcaggagctcttttaggccaggcctggttggtgacaaaatctgtcagcatttgcttgtctgtaaagtattttatttctccttcacttatgaagcttagtttggctggatatgaaattccgggttgaaaattcttttctttaagaatgttgaatatcggcccccactctcttctggctggtagagtttctgccgagagatcagctgttagtctgatgagcttccctttgtgggtaacccgacttttctctctggctgcccttaacattttttccttcatttcaactttggtgaatccgacaattatgtgtcttggagttgctcttctcgaggactatctttgtggcattctctgtatctcctgaatctgaatgttggcctgccttgctagattggggaagttctcctggataatatcctgcagagtgttttccaacttggtgccattcttcccgtcactttcaggtacaccaatcagacgtagatttggtcttttcacatagtcccatatttcttggaggctttgttcgtttctttttattcttttttctctaaacttcccttctcacttcatttcattcatttcgtcttccatcactgataccctttcttccagttgatcgcatcggctcctgaggcttctgcattcttcacgtagttcttgagccttggctttcagctccatcagctcctttaaggacttctctgcattggatattctaggtagccattcgtctaattttttttcaaagtttttaacttctttgccattggtttgaatttcctcctgtagctcagagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctattttttccccatctttgtggtttttgtctacttttggtctttgatgatggtgacgtacagatgggtttttggtgtggatgtcctttctgtttgttagttttccttctaacagaca

SEQ ID NO: 12720 - DNA, 4723 bp, Homo sapiens
aatggaattctttttttttttattctttaagttttagggtacatgtgcacaatatgcaggtttgttacatatgtatatatgtgccatgttggtgtgctgcacccattaactcgtcatttacattaggtatatctcctaatgctatctctccccctccccccaccccacaacaggccccagtgtgtgatgttccccttcccgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcactgatggacatttgagttggttccaagtctttgctattgtgaatagtgctgcagtaaacatatgtgtgcatgtgtctttataacagcatgatttataatcctttgggtatatacccagtaatgggatggctgggtcaaatggtatttctagttctagatccctgaggaatcgccacactgacttccacaatggttgaactagtttacagttccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtcttttggctgcataaatgtcttcttttgagaagtgtctgttcatattcttcgcccacttgctgatggggttgtttgtttttttcttgtaaatttgtttgagttcattgtagattctggatattagccctttgtcagatgactagattgcaaaaattttctcccattctgtaggttgcctgttcactctcatggtagtttcttttgctgtgcagaagctctttagtttaattagatcccatttgtcaattttggcttttgttgccattgcttttggtgttttagctgtgaagtccttgcccatgcctatgtcctgaatggtattgcctaggttttcttctagggtttctatggttttaggtctaacatttaagtctttaatccatcttgtattaatttttgtataaggtgtaaggaagggatccagtttcagctttctacatatggctagccaattttcctggcacgatttattaaatagggaattctttcccccatttcttatttttgtcaggtttgtcaaagatcagatagttgtagatatgaggcattatttctggcgcctctgttctgttccattggtctatatctctgttttggtgccagtaccatgctattttggttactgtagccttgtagtatagtttgaagtcaggtagtgtgatgccttcagctttgttctttttgcttaggattgacttggctatgcaggctcttttttggttccatattaactttaaagtagttttttccaattctttgaagaaagtcattggtagcttgatggggatggcattgaatctataaattaccttgggtggtatggccattttcacaatattgattcttcctacccatgagcatggaatgttcttccatttttttgtatcctcttttatttcattgagcagtggtttgtagttctccttgaagaggtccttcacgtcccttgtaaattggattcctaggtattttattctctttgaagcaattgtgaatgggaggtcactcatgatttggctctctgtttgtctgttattggtgtataagaatgcttgtgatttttgcacattgattttatatcctgagacttggctgaatttgcttatcagcttaaggagattttgggctgagacgactggagttttctagatatacaatcatgtcatctgcaaacagggacaatttgacttcctcttttcctaattgaataccctttatttccttctcctgcctgattgccctagccggaacttccaacactatgttgaataggagtggtgagagaggacatccctgtcttgtgccagttttcaaagggaatgcttccagtttttgcccactcagtatgatattggctgtgggtttgtcattgatagctcttattattttgagatatgtcccatcaatacttaatttattgagagttttttagcatgaagtgttgttgaattttgtcaaaggccttttctgcatcttttgagataatcatgtggtttttgttgttggttctgtgtatatgctggattacgtttattgatttgtgtatgttgaaccagccttgcatcacagggatgaagcccacttgatcatggtggataagctttttgatgtgctgctggattcagtttgccagtattttattgaggatttttgcatcgatgttcatcagggatattggtgtaaaattctcttttttttgttgtgtctctgccaggctttggtatcaagatgatgctggcctcataaaatgagttagggaggattccctctttttctattgattggaatagtttcagaaggaatggtatcagctcctccttgtacctctggcagaattcggctgtgaatccatctggtcctagactttttttggttggtaagctattaatgattgtctcaatttcagagcctgttattggtctattcagagattctacttcttcctggtttagtcttgagagggtgtatgtgtccaggaatttatccatttcttctagattttcaaatttatttgcgtagacgtgtttatagtattttctgatggtagtttgtatttctgtgggatcggtggtgatatcccctttatcattttttattgtgtctgtttgattcttctctcttttgttctttattggtcttgctagcagtctttcaattttgttgatcttctcaaaaaaccagctcctggattcattgattttttgaagggttttttgtgtctctatctccttcagttctgctctgatcttatttatttcttgccttctgctagcttttgaatgtgtttgctcttgcttctctacttcttttaattgtgatgttagggtgtcaattttagatctttcctgctttctcttgtgggcatttagtgctataaatttccctctacacaatgatttaaatgtgtcccagagattctggtatgttgtgtctttgttctcattggtttcaaagaacatctttatttctgccttcatttcgttatgtacacagtagtcattcaggagcaggttgttcagtttccatatagttgagtggttttgagggagtttcttaatcctgagctctagtttgattgcactgtggtctgagagacagtttgttacaatttctgttcttttacatttgctgaggagtgctttacttccaactatgtggtcaattttggaataagtgtgttgtggtactgagaagaatgtatattctgttgatttggggtagagagttctgtagatatctattaggtccacttggtgcaaagctgagttcaattcctggatatcctcattaagtttctgtctcgttgatctgtctaatgttgacagtggggtgttaaagtctcccattattattgtgtgggagtctaagtctctttgtaggtctttaaggacttgctttatgaatctgggttctcctgtattgggtgcatatatatttaggatagtcagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcatgtgagttgagtttcctgaatacagcacactgatgggtcttgactgtttatccaatttgctagtctgtgtcttttaattggagcatttagcccatttacatttaagggtaatattgttatgtgtgaatttgatcatgtcattatgatgttagctgcttattttgctcgttagttgatgcagttacttcctagcctcaacagcctttacaacttggcatgtgtttgcagtggctggtactggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctctcctggcttgtagcatttctgccaagagatcagctcttagtctgatgggcttccctttgtgggtaacccgacctttctctctggctgcccttgatattttttccctcatttcaactttggtgaatctgagaattatttgtcttggagttgctcttctcgacgagtatctttgtggcgttctctgtatttcctgaatttggatgttggcctgccttgctaggttggggaagttctcctggataatatcctgcagagtgtttcccaacttggttccattctccccgtcactttcaggtacaccaatcagatgtacatttggtcttttcacttagtcccatatttcttggaggctttgttcatttctttttattatttttt

SEQ ID NO: 12721 - DNA, 5645 bp, Homo sapiens
tatatagatatattttttattatactttaagttctagggtacatgtgcacaacgtgcaggtttgttacatatgtatacatgtgacatgttggtgtgctgcacctgttaactcatcatttacattaggtatttctcctaatgctatctctcccccctccccccaccccacaacaggccccagtgtgtgatgttccccgccctgcgtccaagtgttctcattgttcaattcccacctatgaatgagaacatgcggtgtttggttttttgtccttgcgatagtttgctcagaatgatggtttccagcttcatccatgtccctacaaaggacatgaactcatcattttctatggctgcatagtattccacggtgtatatgtgccacattttcttaatccagtctatcactgttggatatttgggttggttccaagtctttgctattgtgaatagtgccacaataaacatacatgtacatgtgtctttatagcagcatgatttataatcctttgggtatatacccagtaatgggatggctgggtcaaatggtatttctagttctagatccctgaggaatcgccaaaatgtcttccacaatggttgaactagtttacagtcccaccaacagtgtaaaagtgttcctatttctccacatcctccccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgaaaagtatctgttcatatcctttgcccacttgttgatggggttgtttttttcttgtaaatttgtttgagttctttgtagattctagatattagccctttgtcagatgagtagattgcaaaaattttctcccattctgtaggttgcctgttcattctgatggtagtttcttttgctgtgcagaagctctttagtttatttagattgcatttgtcaattttggctttcgttgccattgcttttggtgttttaggcatgaagtcttcgcccatgcctatgtcctgaatggtattgcctaggttttcttctagggtttttatggttttaggtctaacatttaagtcttcaaaccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtattatttctgagggctctgttctgttctattggtctatatctctgttttggtatcagtaccatgctgttttggttactgtagccttgtagtatagtttgaagtcaggtagcatgatgcctccagctttcttcttttggcttaggaatatcttggaaatgcaggctcttttttgtttccacatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttcattgagcagtggtttgtagttctccttgaagaggtccttcacatcccttgtaagttggattcctaggtattttattctctttgaagcaattatgaaagagaattcactcatgatttggctctctgtttgtctgttattggagtataagaatgcttgtgatttttgcacattgattttgtatcctgagactttgctgaagttgtttatcagcttaaggagattttgggctgagacaatggggttttctagatatacaatcatgtcatctgcaaacagggacaatttgacttcctcttttcctaattgaataccctttatttctttctcctgtctgattgccctggccagaaattccaacactatgttgaataggagtggtgagagagggcgtccctgtcttgtgccagttttcaaagggaatgcttctagtttttgtccattcagtatgatattggctgtgggtttgtcataaatagctctcattattttgaggtacgtcccatcaatacctaatttattgagagtttttagcaggaagggctgctgaattttgtcaaaggccttttctgcatctattgagacagtcatgtggtttttgtctttggttctgtttatatgctggattacatttattgacttgcgtatattgaaccagccttgcatcccagggatgaagcccacttgatcacggtggataagctttttgatgtgctgctggattcagtttgccagtattttattgaggatttttgcattgatgttcatcagggatattggtttaaaattttcttttttggttgtgtctctgccaggctttggtaccaggatgatgctgacctcgtaaaatgagttagggaggattctctctttttctattgattggaatagtttcagaaggaatggtatcagctcctccttgtacctctggtagaatttggctgtgactccgtctggtcctggactttttttggctggtaagctattgattattgcctcaatttcagagcctgttattggtctattcagacattcaacttcttcttggtttagtcttgggagggtgtatgtatggaggaatttatccatttcttctagattttctagtttatttgcatagaggtggttatagtattctctgatggtagtttgaatttctgtgggatcggtggtgatatcccctttatcattttttattgtgtctattggattcttccctcctttcctctttattagtcttgctagtggtctatcaattttgttgatcttttcaaaaaaccagctcctggattcgttgattttttgaagggtttttttgtgtctctatctccttcagttctgctctgatcttagttatttcttgccttctgctagcttttgaatgtgtttgttcttgcttctctagttcttttaattgtgatgttagggtgtcaattttagatctttcctgctttctcttgtgggcatttagtgctataattttccctctacacactgctttaaaggtgtcccagagattctggcgtgttgtgtctttgttctcgttggtttcaaagaacatctttatttctgccttcatttcattacgtacccagtagtcattcaggagcaggttgttcagtttccatgcagttgagcggttttgagtaagtttcttaatccagagttctagtttgattgcactgtggtctgagagacagtttgttataatttctgttcttttacatttgttgaggagtgctttacttccacctatgtggtcaattttggaacaggtgtggtgtggtgctgaaaagaatgtatattctgttgatttggggtggagagttctgtagatgtctattaggtctgcttcgtgcagagctgagttcaattcctggatatccttgttaactttctgtctggtggatctgtcgaatattgacagtggggtgttaaagtctcccattattattgtgtgggagtctaagtctctttgtaggtctctaaggacttgctttatgatctgggtgctcctgtattgggtgcatatatatttaggatagttagctcttcttattgaattgatccctttaccattatgtaatggctttctttgtctcttttgatctttattggcttaaagtctgttttatcagagactaggattgcaacctctgcctttttttgttttccatttgcttggttgatcttcctccatccctttattttaagcctatgcgtgtctctgcacgtgagatgggtttcctgaatacagcacactgatgggtcttgactctttatccaatttgccagtctgtgtcttttaattggagcatttagcccatttacatttaaggttaatattgttatgtgtgaatttaatcctgtcattatgatgttagctggtttttgctcattagttgacacagtttcttcctagcatcgatgggctttacaatttgacatgtttttgcagtggctggtactggttgttcctttccatgtttagtgcttacttcaggagctcttttagggcaggcctggcagtgacaaaatctcttagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacatttttttccttcatttcaactttggtgaatgtgacaattatgtgtcttggagttgctcttctcgaggagtatctttgtggcgttctctgtatttctggaatttgagtgttggcctgccttgctaggttggggaagttctcctggataatatcctgcagagtgttttccaacttggtttcattctctacgtcactttcaggtacaccaatcagacgtagatttggtcttttcacatagtcccatatttctttgaaggtttgtttgtttctttttattcttttttctctaaacttctctgctcgcttcatttcattcatttgatcttccatcacagataccctttcttccagttgattgaatcggctactgaagcttgtgcattcgtcacgtagttctcgtgccgtggttttcagctccatcaggtcctttaaggacttctctgcattggttattctagttagccattcatctaatcttttttcaaggtttttaacttctttgccattggttcgaacttcctcctttagctcagagtagtttgatcgtctgaagccttcttctctcagctcgtcaaagtcattctctgtccagctttgttcctttgctggtgaggagctgctttcctttggaggagaagaggtgctctgatttttagaattttcagtttttctgctctgttttttccccatctttgtggttttatctacctttgatctttgatgatggtgacgtacagatggggttttgatgtggatgtccattctgtttgttagttttccttttaacagtcaggaccctcagctgcaggtctgttggagtttgctggaggtccactccagacctgtttgcctgggtaccagcagcagaggctgcagaacagtgaatattgctgaacagcaaatgttgctgcctgatcgttcctctggaagttttgtctcagaggggtacccagctgtgtgaggtgtcagtctgcccctactggggggtgcctcccagttaggctacttgggggtcagggacccacttgaggaggcagtctgtccattctcagatctcaaactccatgctgggagaaccactactctcttcaaagctgtcagacagggacacttaagtctgcagaggtttctgctgccttttgttcggctatgccttgcccccagaggtgcagtctacagaggcatgcaggcctccttgagctgcgttgg

SEQ ID NO: 12722 - DNA, 5229 bp, Homo sapiens; identical to SEQ ID NO: 12719

SEQ ID NO: 12723 - DNA, 6021 bp, Homo sapiens
aaaacatttttttaaaattattattatactttaagttttagggtacatgggcacaatgtgcaggttagttacatatgtatacatgtgccatgctggtgtgcagcacccactaactcgtcatctagcattaggtatatctcccaatgctaaccctccccctccccccaccccacgacagtccccagagtgtgatgttccccttcctgtgtccatgtgttctcattgttcaattcccacctatgagtgagaatatgcggtgtttgtttttttgttcttgtgatagtttactggaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatgatatttctagttctagatccctgaggaatcgccacactaacttccccaatggttgaactagtttacagtcccaccaacagtgtaaacgtgttccaatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcatagatgtctttttttgagaagtgtctgttcatatcctttgcaaactttttgatggggttgtttgtttttttcttgtaaatttgtttgagttcattgtagattctggatattagccctttgtcagatgagtaggttgcgaaaattttcccccattttgtaggttgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaggtcaggtagtgtgatgcctccagctttgttcttttggcttaggattgacttggcgatgcaggctctattttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtttaagaatgcttgtgatttttgtacattgattttgtatcctgagactttgccgaagttgcttatcagcttaaggagattttgggctgagacaatggggttttctagatatacaatcatgtcatctgcaaacagggacaatttgacttcctcttttcctaattgaataccctttatttccctctcctgcctaattgccctggccagaacttccaacactatgttgaataggagtggtgagagagggcatccctgtcttgtgccagttttcaaagggaatgcttccagtttttgcccattcagtatgatattggctgtgggttcgtcatagatagctcttattattttgagataagtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctgatcctggactctttttggttggtaagttattgattattgccacaatttcagctcctgttattggtctattcagagattcaacttcttcctggtttcgtcttgggagagtgtatgtgtcgaggaatttatccgtttcttctagattttctagtttatttgcgtagaggtgtttgtagtattctctgatggtagtttgtatttctgtaggatcggtggtgatatcccctttatcattttttattgcatctatttgattcttctcgctttttttctttgttagtcttgctagcggtctatcaattttgttgatcctttcaaaaacccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattgtggtatgttgtgtctttgttctcattggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagctatctatgaggtccgcttggtgcagagctgagttcaattcctgggtatccttgttgactttctgtctcgttgatctgtctaatgttgacagtgggatgttaaagtctcccattattaatgtgtgggagtcgaagtctctttgtaggtcactcaggacttgctttatgaatctgggtgctcctgtattgggtgcatatatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacaatttaaagttaatattgttatgtgtgaatttgatcctgtcattatgatgttagctggttattttgcttgttagttgatgcagtttcttcctagtctcgatggtctttacattttggcatgttttgcagcggctggtaccggttgttcctttccatgtttagcacttccttcaggagctcttttagggcaggcctggtggtgacaaaatctctcagcatttgcttgtctgtgaagtattttatttctccttcacttatgaagcttagtttggctggatatgaaattctggattgaaaattcttttctttaagaatgttgaatattggcccccactctcttctggcttgtagagtttctgccgagagatctgctgttagtctgttgggcctccttttgagggtaacccgatctttctctctggctgcccttaacattttttccttcatttcaactttggtgaatctgacaattatgtgtcttggagttgctcttctcgagaagtatctttgtggcgttctctgtatttcatgaatctgaatgttggcctgccttgctagattggggaagttctcctggataatatcctgcagagtgttttccaacttggttccattctccccgtcactttcaggtacaccagtcagacgtagatttggtcttttcacatagtcccatatttcttggaggctttgctcgtttctttttattcttttttctctaaacttcccttctcacttcatttcattcatttcatcttccatcactgataccctttcttccagttgatcgcatcggctcctgaggtttctgcattcttcacgtagttctcaagccttggttttcagctccatcagctcctttaagcacttctctgtattggttattctagttatacattcttctaaatttttttcaaagttttcaacttctttgcctttggtttgaatttcctcccgtagctcggagtaatttgatcgtctgaaggcttcttctctcagctcgtcaaagtcattttctgtccagctttgttctgttgctggtgaggaactgcgttcctttggaggaggagaggctctctgctttttacagtttccagtttttctgctctgttttttccccatctttgtggttttatctacttttggtctttgatgatggtgacgtatagatggggttttggtgtggatgtccttcctgtttgttagttttccttctaacagacaggaccctcagctgcaggtctgttggagtacccggccgtgtgaggtgtcagtctgcccctgctagggggcgcctcccagttaggctgctcgggggtcaggggtcagggacccacttgaggaggcagtctgcccgttctcagatctccagctgtgtactgggagaaccactgctctcttcaaagctctcagacagggacatttaagtctgcagaggttactgctgtctttttgtttgtctgtgccctgcccccagaggtggagcctacagaggcaggcaggcctccttgagctgtggtgggctccacccagttcgagcttcccggctgttttgtttacctaagcaagcctgggcaatggcgggcgccccttccccagcctcgttgccgccttgcagtttgatctcagactgctgtgctagcaatcagcgagactccgtgggcgtaggaccctccgagccaggtgggggatataatctcgtggtgcgccgttttttaagcccgtcggaaaagcgcagtattcgggtgggagtgacccgattttccaggtgccgtctgtcaccactttctttcactaggaaagggaactcttgcgcttcccagtgaggcaatgcctcgccctgcttcaccttgtgcacggtgcgcgcacccactgacctgcacccactgtctggcacttcctagtgagatgaacccggtacctcagatggaaatgcagaaatcacccgtcttctgcgtcgctcacgctgggagctatagactggagctgttcctattcggtcatcttggc

SEQ ID NO: 12724 - DNA, 6245 bp, Homo sapiens
ttttttgtgcttttagtagagacgggttttcactgtgttagccaggatggtctcgatctcctgacctcgtgatccgcccgcctcagcctcccaaagtgctgggattacaggcgtgagccaccacgcccagccaaaagattctttttttttgaaaatatgcaagatgtaaatatttttcttttatttatttatttatttatttatttatttattattatactttaagttttagggtacatgtgcacattacgcaggttagttacatacgtatacatgtgccatgctggtgtgctgcacccactaactcgtcatttagcattaggtatatcgcccaatgctatccctcccccctccccccaccccacaacagtccccagagtgtgatgttccccttcctgtgtccatgtgatctcattgttcaattcccacctatgagtcagaatatgcggtatttggttttttgttcttgtgatagtttactgagaatgatggtttccaatttcatccatgtccctacaaaggacatgaactcatcattttttatggctacatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcgtatttctccacatcctctccaccacctgttctttcctgacttttcaatgatcgccattctaactggtgtgagatagtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttctcaattttgtcttttgttgccattgcttttggtgttttaaacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcctttggcttaggattgacttggcaatgggggctcttttttggttccatatgaactttaaagtagttttttccaattctgtgaagaaaggcattggtagcttgatggggatggcactgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagatggattcctaggtattttattctctttgaagcaattgtgaatgggagttcactcatgatttggctctctgtttgtctgttattggtgtataagaatgcttgtgatttttgcacattgattttgtgtcctgagactttgctgaagtcgcttatcagcttaaggagattttgggctgagacaatggggttttctagatatacaatcatgtcatctgcaaacagggacaatttgacttccttttttcctaattgaataccctttatttccttctcctgcctaattgccctggccagaacttccaacactatgttgaataggagtggtgagagagggcatccctgtcttgtgcccccctgtcttgtgcccgttttcaaagggaatgcttccagtttttgcccattcagtatgatattggctgtaggtttgtcatagatagctcttattattttgaaatatgtcccatcaatacctaatttattgagagtttttagcatgaaaggttgttgaattttatcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgaagctggcctcataaaatgagttagggaggattccctctttttctatcaattggaatagtttcagaaggaatggtaccagttcctccttgtacctctggtagaattcggctgtgaatccatctggtcctggactccttttggttggtaagctactgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcatctatttgattcttctctctttttttctttattagtcttgttagcagtctatcaattttgttgatcctttcaataaaccagctcctggattcatcaattttttgaagggttttttgtgtctctatttccttcagttctgctctgattttagttatttcttgccttctgctagctttggaatgtgtttgctcttgcttttctagttcttttaattgtgatgttagggtgtcaattttagatctttcctgctttctcttgtgggcacttagtgctataaatttccctctacacactgctttgcatgcgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgcaggtcactcaggacttgctttatgaatctgggtgctcctgtattggatgcatatatatttaggatagttagctcttcttgttgaaatgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttagttggagcatttagtccatttacatgtaaagttaatagtgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttctttctccttcacttctgaagcttagtttggctggatatgaaattctggattgaaaattcttttctttaagaatgttgaatattggcccccactctcttctggcttgtagggtttctgcagagagatccgctgttagtctgatgggcttccctttgagggtaacccgacctttctctctggctgcccttaacattttttccttcatttcaactttggtgaatctgacaattatgtgtcttggagttgctcttctccaggagtatctttgtgccgttctctgtatttcctgaatctgaacgttggcctgccttgctagattggggaagttctcctggataatatcctgcagagtgttttccaacttggttccattctccccatcactttcaggtacaccaatcagacgtagatttggtctcttcacatagtcccatatttcttggaggctttgctcgtttctttttattcttttttctctaaactttccttctcgcttcatttcattcatttcatcttccattgctgataccctttcttccagttgatcacgtcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctctgtccagctttgttctgttgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggagggagtctgcccattctcagatctccagctgcgtactgggagaaccactgctctcttcaaagctgtcagacagggacacttaagtctgcagaggttactgctgtctttttgtttgtctgtgccctgcccccagaggtggagcctacagaggcaggcaggcctccctgagctgtggtgggctccacccagttcgagcttccaggatgctttgtttacctaatcaagcctgggcaatggtaggcgcccctcccccagcctcgctgccaccttgcagtttgatctcagactgctgtgctagcaatcagcgagactccgtggggtaggaccctccgagccaggtgggggatataatctcgtggtgcgccattttttaagcccgtcggaaaagcgcagtattcgggtgggagtgacctgattttcccggtgctgtctgtcaccccttctttgattaggaaagggaactaactccctgactccttgcgcttcccaagtgaggcaatgcctcgccctgcttcggctggcgcagggtgcgcgcacccactgacctgcgcccactgtctggcactccctagtgagatgaacccggtacctcagatggaaatgcagaaatcacccgtcttctgtgtcgctcaggctgggagctgtagaccagagctgttcctattcggccatcttggctcctcccc

SEQ ID NO: 12725 - DNA, 4832 bp, Homo sapiens
tgttaatttttttttattatactttaagttttagggtacatgtgcacaaagtgtaggtttgctacatatgtacacatgtgccatgttggtgtgctgcacccattaactcctcatttaacattaggtatatctcctaatgctatccctaccccctccacccaccccacaacagtccccagtgtgtgatgttccccttcctgtatccatgtttcctcattgttcaattcccacctatgagtgagaacatgtggtgtttggttttttcccttgcaatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccacaataaacatacgtgtgtatgtgtcttttgagcagcatgatttgtaatcctttgggtatatacccagtaatgggatggctgggtcaaatggtatttctagttctagatccctgaggaatcaccacactgacttccacagtggttgaactagtttacagtcccatcaacagtataaaagtgttcctatttctccacatcttctccagcacctgttgtttcctgactttttaatgatcgccattctaactggtgtgagatggtatctcattgtggttttgatttgcatttctctgatggccagtgatgatgagctttttttcatgtgtcttttggctgcataaatgtcttcttttgagaagtgtctgttcatttcctttgcccacattttgatggggttgtttgttttcttcttgtgaatttgtttgagttcattgtagattctggatattagccatttgtcagatgagtaggttgcaaaacttttctcccattctgtaggatgtctattcactctgatgatagtttcttttgctgtgcagaagctccttagtttaattagatcccatttgtcaattttgtcttttgttgccattgcttttggtgttttagacatgaagtccctgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccctatttcttgtttttgtcaggtttttcaaagatcagatagttgtagatatgtggcattatttctgagggctctgtcctgttccattggtctatatctctgttttggtactagtaccatgctgttttggttactgtagccttgtagtatagtttgaagtcaggtagcatgatgcctccagctttgttcttttgccttagaattgatttggcaatgcaggctcttttttggttccatatgaactttaaagtagtttttttccaattctgtgaagaaagtctttggtagtttgatggagatggcattgaatctttaaattaccttgggcagtatggccattttcaagatattgattcttcctacccatgagcatggaatgttcttccatttgtttgtatccttttttatttcattgagcagtgatttgcagttctccttgaagaggtccttcacatcccttgtaagtggtattcctaggtattttattctctttgaagcaattgtgaatgggagttcactcatgatttggctctctgtttgtctgttattggtgtataagaatgcttgtgatttttgcacattgattttgtatcctgagactttgctgaagttgtttatcagcttaacgagattttgggctgagatgatggggttttccacattcacaatcatgtcatctgcaaacagggacaatttgactgcctcttttcctaattgaatgccctttatttccttttccttcctgattgccctggccagaacttccaacactatgttgaataggagtggtgagagagggcatccctgttttgtgccagttttcaaagggaatgcttccagtttttgccattcagtatgatattggctgtgggtttgtcatagatagctcttattattttgagatacgttctatcaatccctaatttattgacagtttttagcatgaagatttgctgaattttgtcaaaggacttttctgcgtctattgagataatcatgtggtttttgtctttggtcctgtttatatgctggattacgtttactgattttcatatgttgaaccagcctttcatcccagggatgaaacccgcttgatcatggtggataagctttttgatgtgttgtaggattctgtttgccagtattttattgaggatttttgcatcactgttcatcaaggatattggtctaaaattctctttttttgttttgtctctgccaggctttggtatcaggatgatactggcctcataaaatgagttagggaggattccctctttttctattgattggaatagtttcagaaggaatggtaccagctcctccttgtgccactggtagaatttggctgtgaatccatctggtcctggactttttttggttggtaagctattaattattgcctcaatttcagagcctgttattggtctattcagagattcagcttcttcctggtttagtcttgggagagtatacgtgtcgaggaatttatccatttcttctatattttctagtttatttgtgtagaggtgtttatagtattctctgatggtagtgtgtatttctgtgggatcggtggtgatatcccctttgtcaatttttattgcatctatttgattcttctttcttttcttctttattagtcttgctggtggtctatcaattttgttgatcttttcaaaaaaccagctcctggattcattgattttttgagggttttttgtgtctctatttccttcagttctgctctgatctaagttacttcttgccttctgttatcttttgaatgtgtttgttcttgcttctctagttcttttaattgtgatgttaggatgtcaattttagttctttcatgctttctcttgtgggcatttagtgctataaatttccctccacacactgctttgaatgtgtcccagagatactggtatgttgtgtctttgttcttgttggtttcaaataaaatctttatttctgccttcatttcgttatgtacccagtagtcattcaggagcaggttgttcagtttccatgtagttgagtggtcttgagtgagtttttaaatcctgagttgtagtttgattgcactgtgttccgagagacagtttgttatactttctgttcttttacatttgctaaggagtgctttacttccaattatgtgctcaattttggaataggtgtggtgtggtgctgaaaagaatacatattctgttgatttggggtacagagttctgtagatgtctattaggtctgcttagggcagagctgagttcaattcctgtatatccttgttaactttctgtctcgttgatctgtctaatgttgacagtggggtgttaaagtctcccattattattgtgtggaagtctaaatcactttgtaggtcactaaggacttgctttatgaatctgggtgcttctgtattgtgtgcatatatatttagaatagttagttcttgttgaattgatccctttaccattatgtaatggccttctttgtctcttttgatctttgttggattaaagtctgttttatccgagactaggattgcaacccctgcctttttttgttttccatttgcttggtagatcttcctccatccctttattttgagcctatgtgtgtctctgcacgtgagatgggtttcctggatacagcacactgatgggtcttgactctttatccaatttgcctgtctgcaccttttaattggagcatttaacccatttacatttaaggttagtattgttatgtgtgaatttgatcctgtcattatgacgttagctggttattttcctcgttagtttatgcagtttcttcctagccttgatggtctttacaatttggcatggttttacagtggctggtaccagttgttcctttccatgtttagtgcttccttcaggagatcttttagggcaggcctggtggtgacaaaatctctcagcatttgcttgtctgtggagcatattatttctccctcacttatgaaggttagtttggctggatatgaaattctgggttgaaaattctttcctttaagaatgttgaatattggcccctactctcttctggcttatagagtttctgcagagagatcagcagttagtctgatgggcttccttttgtgggtaacccgacctttctctctggctgcctttaaaattttttctttcatttcaactttggtgaatctggcaattatgtgtcttggaattgctcttctcgaggagtatctttgtggcattctctgtatttcctgaatgtgaatgttggcctgccttgctagattggggaagttctcctggataatatcctgcagagtgttttccaacttggttccattctccccgtcactttcaggtaaaccaaatagacgtagatttgttctattgacatagtcccatatttcttggaggctttgttcatttctttttattcttttttctctaaacttctcttcatgcttcatttcattcatttcatcttccatcgctgataccctttcttcccgttgatcacatcggttactgaggcttatgcatttgtcgtgtagttctcg

SEQ ID NO: 12726 - DNA, 8371 bp, Homo sapiens
tttttttttttttttttttttttttttttttaagacagagtctctgtcacccaggctggagggcagtggcacgatcttggctcattgcaacctccgcctcccaggttcaagcgattctcgtgcctcagcctcccaaacacctggggattacaggtgcccaacaccaggcccagctaatttttatatttctagtagagatggggtttcatcatgttggccaggcttgtcttgaactcctgacctcagatgatccaacagcctcagcctcccaaagtgttcagattaaggcgtgagctaccgcgcccagccagacagatcttgatgtgagttcttgttttgctaccgactagcatgggcaagttatacaacccttgtagatctctattctttcatctcaaaacagactaactttaccctcttcatagagttatcatgagaataaatgatagaatgcaactgaagtgcttgcaagagtatgtggcacatagtaagtgttcagtatgcaccagctattgcattattatcttagatcttagaggagaagtaacttgcctgagtcacccagttagagctagagccagggctagaatctaggcttcctgacaccatgcctgggtgctttctactatcccatggcattgtgaaagctgcttgtgacgatctaatatggctgttggctgggatggatgcagggggtgcttacaaatactgggcagtaaaaaatgagaaatgtggctgggactggtggctcacacctgtaatcccagtgctttgggaggccgaggcaggcaaattgcctgaggtcaggagtttgagaccagcctggccaacatggtaagactctatctctactaaaaatacaaaaattagctgggcatggtggcgcatggctatagtcccagctactcaggaagctgaggcaggagaatcacttgaacctgggaggcagatgtggcagtgagccaagatcatgccactgcattccagcctgggggacagaatgagactccatctcaaaaaaaaagagagagagaaatgtggatccaaattctatcttggccttcactggcctatgttgacctagatgggaggagccacttgaagcatctctctgactcttttctcttctcagagagaagtggtccatctgagtaagtttccagggcaccagtcagaatgcattagtaacagggggtagaccatgtcctaaagtccgtggatatgggcgtagctgggtctctcttatcacttccacccaaggggatggaggaataaatttacccccaggtaggtacctccagaggtttcttttctttcgctttgttttttttgagatggagtttcactcttatctcctaggctgagtgcaacggcgctatctccggccaccacaacctctgcctcccacattcaactgattcttctgccttagcctcctgagcagctgagtgggattacaggtacatgccaccatgcccggctaatttttgtatttttagtagagatggggtttcaccacattggacaggctgatctcgagctcctgacctcaggtgatttgcccaccttggcctcccaaagtgctgggattataggtgtgagccgccacacccggcccagaggtttctattctaaaaagcacaccccacatgtatatctgctggcatttaccttgagattgtcgggcagttcagccctgccagcatacccggggttcatggtgatgaacacagcgcaggttgggttcagagagagctcagtcccttcaaagatgaatgtctttagcttccgaatgatggcttgttggatgctgaggatctgctgagcgaccacagacagcacttctacctggggtgagaatgcccggctgataagagcatctgcttctgtctgacaaccaccctactctaccggagtcctcccacatagcaaagaaagaacccaatcacccaaaaaccgcacctgcacattcaaaattaggagcatgatttggggttttggtaagaaaaaagaatataggtttgtgcatgtgtgcatgtgcgtgtgtgtgtgtgttaatagtttccatagtactttatctttgtttcaacacctagcatagtacttgacacacagtaggtattctgtgtttattggttcaaagatcagggatttttatatttcctgatctttattcatcatccaaagagaattatacactcttttgtgatgcatcttttgtacttctactatagacttttagcacgttggtatttgtttcattaaattttttatttccctttactagatcgcaacagtctagacagcaagatcttttttcttttttttaattattatactttaagttttagggtacacgtgcacattgtgcaggttacatatatatacatgtgccatgctggtgcgctgcacccactaactcgtcatctagcattaagtatatctcccgatgctatccctccccactcccaccaccccacaacagtccccagagtgtgatattccccttcctgtgtccatgtgatctcactgttcagttcccacctatgagtgagaatatgcggtgtttggttttttgttcttgcgatagtttactgagaatgatgatttccaatttcatccatgtacctacaaaggacatgaactcatcattttttatggctgcatagtattccatggtgcatatgtgccacattttcttaatccagtctatcattgttggacatttgggttggttccaagtctttgctattgtgaataatgctgcagtaaacatacgtgtgcatgtgtctttatagcagcatgatttatagtcatttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcttaggttttcttctagggtttttatggttttaggtctaacgtttaagtctttaatccatcttgaattgatttttgtataaggtgtaaggaagggatcaagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagggtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctgggcagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcggatattgaaccagccttgcatcccagggatgaagcctacttgatcagggtggataagctttttgatgtcctgctggattcggtttgccagtattttattgaagatttttgcatcgatgttcatcaaggatattggtctaaaattctctttttttgttgtgtctctgcctggctttggtatcagaatgatgctggcctcataaaatgagttagggaggattccctctttttctattgattggaatggtttcagaaggaatggtaccagttcctccttgtacctctggtagaattcggctgtgaatccatctggtcctggactctttttgattggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgtgtctatttgattcttctctctttttttctttattagtcttgctagcagtctatcaattttgttgatcctttcaaaaaaccagcttctggattcattaattttttgaagggttttttgtgtctctatttccttcagttctgctctgattttagttatttcttgccttctgctagctttcgaatgtgtttgctcttgcttttctagttcttttaattgtgaagttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctaatttgattgccctgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcaaatatatttaggatagttagctcttcttgttgaattgatccctttaccattatgtaatggccttctttgtctcttttgatctttgttggtttaaagtctgttttatcagagactaggattgcaacccctgcctttttttgtttttcattggcttggtagatcttcctccatccttttattttgagcctatgtgtgtctctgcatgtgagatgggtttcctgaatacagcacactgatgggtcttgactctttatccaattttccagtctgtgtcttttaattggagcatttagtccatttacatttaaagttaatgttgttatgtgtgaatttgatcctgtcatgatgatgttagctggttattttgctcgttagttgatgcagtttcttcctagtctcgatggtctttacattttggcatgatttcgcagcggctggtaccggttgttcctttccatgtttagtgcttccttcaggagctcttgtaaggcaggcctggtggtgacaaaatttctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgcagagagatccgctgttactctgacacgcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctagacttcccttctcgcttcatttcattcatttcatcttccatcgctgataccctttcttccagttgatcgcaccggctcctgaggcttctgcattcttcacgtagttctctagccttggttttcagctccatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagccattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaagcagtctgcccgttctcagatctccagctgcgtgctgtgagaaccactcctctcttcaaagctgtcagacagggacatttaagtctgcagaggttactgctgtctttttgtttgtctgtgccctgcccccagaggtggagcctgcagaggcaggcaggcctccttgagctgtggtgggctccacccagttcgagcttccaggctgctttgtttacctaatcaagcctgggcaatggcgggcgcccctcccccagccaggctgccgtcttgcagtttgatctcagactgctgtgctagcaatcagcgagactccgtgggcgtaggaccctccgagccaggtgcaggatataatctcgtggtgccccgttttttaagcccatcagaaaagcgcagtattcgggtgggagtgacccgattttccaggtgccgtctgtcacccctttctttgactcagaaagggaactccctgaccccttgcgcttcccaggtgaggcaatgcctcgccctgcttcggctggcgcacggtgcacgcacccactgacctgcgcccactgtctggcactcccgagtgagatgaacccggtacctcagatggaaatgcagaaatcacccgtcttcttcgtcgctcacgctgggagctgtagaccggagctgttcctattcggccatcttggctcctccctccttttttttttttttaaacagag

SEQ ID NO: 12727 - DNA, 4958 bp, Homo sapiens
gttattttctttttttattttttattttattattattatactttaagttttaggatacatgtgcacaatgtgcaggttagttacatatgtatacatgtgccatgcggggtgtgctgcacccattaactcgtcatttagcattaggtatatctcctaaagctatccctcctccctccccccaccccacaacagtcctcagagtgtgatgttccccttcctgtgtccatgtgttctcattgttcaattcccacctatgagtgagaatatgcggtgtttggttttttgttcttgcgatagtttactgagaatgatgatttccaatttcatctatgtccctacaaaggacatgaactcatcattttttatggctgcatagtattccatggtgtatatgtgccacattttctttttttttttttttttttttgagacggagtctcgctctgtcgcccacccgggaggcggagcttgcagtgagccgagatcccgccactgcactccagccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctaggtcaaatggtatttctagttctagatccctgaggaatggccacactgacttccacaatggttgaactagtttacagtcccaccaatagtgtaaaagtgttcctatttctccacatcctctccagcacctgtcgtttcctgactttttaatgattgccattctaactggtgtgagatggtatctcattgtggttttgatttgcatatctctgatggccagtgatggtgagcattttttcatgtgttttttggctgcataaatgtcttcttttgagaagtgtctgttcatacccttagcccactttttgatggggttgtttgtttttttcttgtaaatttgtttgagttcattgtagatactggatattagccccttgtcagatgagtaggttgcgaaaatgttctcccatgttgtaggttgcctgttcactctgatggtagttttttttgctgtgcagaagctctttagtttaattagatctcatttgtcaattttggcttttgttaccattgcttttggtgttttagtcatgaagtccttgcccatgcctatgtcctgaatggtattgcctagattttcttctagggtttttatggttttaaatctaacatttaagtctttaatccatcttgaattaatttttgtataaggcgtaaggaaaggatccagtctcagctttctacatatggctagccagttttcccagcaccatttattaaaaatggaatcctttccccatttcttgtttttgtcaggtttgtcaaagagcagatggttgtagatgtgtggtgttatttctgagggctctgttctgttccactggtctatacctctgttttggtaccagtaccatgctgttttggttactgcagccttgtagtatagttcgaagtcaggtagcatgatgcctccagctttgttctttttacttaggagtgtcttggcaatgtgggctcttttttggttccatatgaactttaaagtagtttttttccaattttgtgaagaaagtcattggtagcttgatgggaatggcattgaatctataaattaccttgggcagtatggacattttcatgacattgattcttcctatccgtgagcatggaatgttcttccatttgtttgtgtcctcttttatttcattgagcagtggtttgtagttctccttgaagaggtccttcacatcccttgtaagttggattcctaggtgttttattctctttgaagcaattgtgaatgagggttcactcatgagttggctgtctgtctgttattggtgtataggaatgcttgtgattttttgcacattgattttgtatcctgagactttgctgaagttgcttatcagcttaaggagattttgggctgagacagtggggttttctagatacacaatcatgtcatctgcaaacagggatgatttgacttcctcttttcctaattgaataccctttatttccttctcttgcctgattgccctggccagaacttccaacactatattgaataggagtggtgagagagggcatccctgtcttgtgctggttttcaaagggaatgcttccagttttcgtccattcagtatgatattggctgtgggttggtcataaatagctcttattattttgagatacgtcccatcaatacctagtttatttagagtttttagcatgaagggctgttgaattttgtcgaaggccttttctgcatctattgagataatcctgtggtttttgtctttggttctgtttatatgctggattacatttattgatttgcgtatgttgaaccagccttgcatcccagggataaagcccacttgatcttggtggataagctttttgatgtactgctggattcggtttgcccgtattttattgaggatttttgcatcgatgttcatcagggatattggtctaaaattctgttttttttgttgtgtctctgccaggctttggtatcaggatgatgctggcctcataaaatgagttagggaggattccctctttttctgttgattagagtagtttcagaaggaatggtaccagctcctctttgtacctctggtagaattcggctgtgaatccgtctgttcctggactttttttggttggtaggctattaattattgcctaatttcagagcctgttattggtctattcagggattcagcttcttcctggtttagtcttgggagggtgtatgtgttgaggaatttatctatttcttctagattttctagtttatttgcgtagaagtatttatagtattctctgatggtagtttgtatttctgtgggatcggtggtgatatcccctttataattttttattgcgtccatttgattcttctctcttttcttctttattagtcttgctagcagtctatcaattttgttgatcttttcaaaaaatcagctcctggattcattaattttttgaagggttttttgtgtctctatccccttcagttctgctctgatcttagttatttcttgccttctgctagcttttgaatgtgtttgctcttgcttctctagttcttttaattgtgatgttagggtgtcaattttagatcttgccggctttctcttatgggcatttagtgctacaaatttccctctacacaccgctttaaatgtgtcccagagattctggtactttgtgtctttattcttattggtttcacacaacatctttatttctgccttcatttcgttatgtacccagtagtcattcaggagcaggttgttcagtttccatgtagttgtgtagttttgagtgagtttcttaatcctgagttctaatttgattgcactgtggtctgagtgacagtttgttgtgatttctgttcctttatatttgatgaggagtgctttacttccaattatgtggtcagttttaaaataagttagatgtggtgctgagaagaatgtatattctgttgattttgggtggagagttctgtagatgtctattaggtccacttggtgcagagctgagttcaagtcctggatatccttgttaactttctgtcctgttcatctgtctaatattaacagtgaggtgttaaagtctcccattattattgtgtgggagtctaagtctctctgtaggtcactcaggacttgctttatgaatctgggtgctcctgtattgggtgcatatatgtttaggaaagttagctcttcttgttgaattgatccctttaccattatgtaatggccttctttgtctcttttgatctttgttggtttcaagtctgtttcatcagagactaggattgcaacccttgcttttttttttgctttccatttgcttggtagatcttcctccatccctttattttgagtctatgtgtgtctctgcacatgagatgggtctcctgaatacagcacggtgatgggtcttgattctttatccaatttgccagtctgtgtcttttaattggggcatttagcccatttacatttaaggttaacattgttatgtgtgaatttgatcctgtcattatgacgttagctggttattttgctcgttcgttgatgcagtttcttcctagcattgatggtctttataatttggcatgtttttgcagaggctggtaccaattttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgagttgaaaattcttttctttgagattgttgaacgttggactccactctcttctggcttgtagagtttctgccgagagatccgctgttagtctgatgggcttccctttgtgggtaacccgacctttctctctggctgcccttgacattttttccttcatttcaaccttggcgaatctgacaattatgtgtcctgaggttgctgttctcgaggagtatctttgtggtgttctctgtatttcgtgaatttgaatgttggcctgccttgtaggctggggaagttctcctggacaatatcctgaagagtgttttccaacttggttccattctccctgtcactttcaggtacaccaatcaaacgcagatttggtcttttcacatagtcccatatttcttggaggctttgttcatttatttttgcttttttctctaaacttctcttcttgcttcacttcattaatttgatcttcaatcactgataccctttcttccacttgatcgaattggctactgaagcttgtgcatgcgtcacgtagttct

SEQ ID NO: 12728 - DNA, 6180 bp, Homo sapiens
tttatggtcttaacttttttttttttattattatacattaagttttagggtacatgtgcacattgtgcaggttagttacatatgtatacatgtgccatgctggtgcactacacccactaactcgtcatctagcattaggtatatctcccaatgctgtccctcccctctcgccccaccccacaacagtccccagagtgtgatattccccttcctgtgtccatgtgatctcattgttcaattcccacctatgagtgagaatatgcggtatttgttttttgttcttgcgatagtttactgagaatgatgatttccaatttcatccatgtccctacaaaggacattaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccagcaacagtgtaaaagtgttcctatttctccacatcctctccagcacctgttgtttcctgactttttaatgattgccattctaactggtgtgagatggtatttcatagtggttttgatttgcatttctctgatggccactgatgatgagcattttttcatgtgttttttggctgcataaatgtcttcttttgagaagtgtctgttcatgtccttcacccactttttgatggcgttgtttgtttttttcttgtacatttgtttgagttcattgtagattctggatattagccctatgtcagatgagttggttgcaaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaaatctttaatccatcttgaattgatttttgtataaggtgtaagggagggatccactttcagcttcctacatatggctagccagttttcccagcaccatttattaaatagggaatcctttccccattgcttgtttttctcaggtttgtcaaagatcagatagttgtagttatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaatcattggtagcttgatggggatggcattgaatctgtaaattaccttgggcagtatggccattttcacgatattgattcttcctacccatcagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgccaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgatgggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcggtttgccagtattttattgaggatttttgcatcaattttcatcaaggttattggtctaaaattctcttttttggttgtgtctctgcctgactttggtatcaggatgatgctggcctcataaaatgagttagggaggattccctctttttctattgattggaatagtttcagaaggaatggtaccagttcctccttgtacctctggtagaattcggctgtgaatctatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattatgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggctttgagtgggattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccgttattaatgtgtgggagtctaagtctctttgtaggtcactcaggacttgctttatgaatctgggtgctcctgcattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggttttcctgaatacagcacactgatggatcttgactctttatccaatttgccagtctgtgtcttttaattggagaatttagtccatttatatttaaatttaatattgttatgtgtgaatttgatcctgtcattatgattatagctggtgattttgctcgttagttgatgcagtttcttcctagtctcgatggtctttacattttggcatggttttgcagtggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacctgacctttctctctggctgcccttaacattttttccttcatttcaactttggtgaatctgacaattatgtgtcttggagttgctcttcttgaggagtatctttgtggcgttctctctatttcctgaatctgaacattggcctgccttgctagattggggaagttctcctggataatacatgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgatcgcattggctcctgaggcttctgcattcttcacgtagttctcgagccttggtttgcagctccatcagctcctttaagcacttctctgtattggttattctagttatacattcttctaaatttttttcaaagttttcaacttctttgccttcggtttgaatgtccttccatagctcagagtaattcgatcgtctgaagccttcttctctcagctcgtcaaagtcattctccatccagctttgttctgttgctggtgaggaactgcgttcctttggaggaggagagacgctctgtgttttagagtttccagtttttctgttctgttttttccccatctttgtggttttatctacttttggtctttgatgatggtgatgtacaggtgggtttttggtgtggatgtcctttctgtttgttagttttccttgtaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcaggttctcagatctccagctgtgtgctgggagaaccactcctctcttcaaagctgtcagacagggacatttaagtctgcagaggttactgctgtctttttgtttgtctgtgccctgcccccagaggtggagcctacagaggcaggcagacctccttgagctgtggtgggctccacccagttcgagcttcctagctgctttgtttacctaagcaagcctgggcaatggcggacgcccctcccccagcctcgctgctaccttgcagtttgatctcagactgctgtgctagcaatcagcgagattccgtgggcataggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgctcacccactggcctgcgcccactgtctggcactccctagtgagatgcacccagtacctcagatggaaatgcagaaatcacccgtcttctgcgtcgctcacgctgggagctgtagactggagctgttcctattcggccatcttggctcctcctggtcttaacttttatgaactcttatacagccacttgtccaattttccaaaacagcaattctaaacttttctctccagctaattattaaacttaatatcctatcctgatgctattggaagattgtcactccagagac

SEQ ID NO: 12729 - DNA, 6703 bp, Homo sapiens
atatgttctttcttttttttttttttttttttttttttggagacagagtttcgctcttgttgcccaggctggagtgcaatggcacaatctcggctcaccgcaacctctgcctcccaggttcaagcaattctcctgcctcagcctcccgagtagctgggattacaggcatgtaccaccacgcctggctgattttgtatttttagtagagacggggtttctccatgttcaggctggtctcgagctcctgacctcaggtgatccgcccgcctcggcctcccaaagtgctgggattacaggcgtgagccaccgcgcccagccgggatatgttcttttattaataaaaactatatgctaattatggaaggaacattcataggactaataagagaataggcatgaacaaaaattttctaagactcctgacatccattaattagaaaaatacacttttcatgctggattatgaataagtaaagtttttagaatcataatatgttagaaccacaataaattttagaaattatgtagtatcaagcctcttttgcacattaaaaagctggtcatttagaatttttttttttttatactttaagttttagggtacatgtgcacaatgtgcaggttagttacatatgtatacatgtgccatgatggtgtgctgcacccattaactcgtcgtttagcattagttatatctcctaatgctatccctcgcccctcccccaactccacaacagcgccccagagtgtgatggtccccttcctgtgtccatgtgttctcattgttcaattcccatctatgagtgacaacatgcagtgtttggttttttgtccttgcgatagtttgctgagaatgatgatttccagtttcatccatgtccctgtaaaggacatgaactcatcattttttatcgctgcatactattccacggtgtacatgtgcccaattttcttaatccagtctgtcattccgggacatttgggttggttccaagtctctgctatcgtgaatagtgccgcaataaacatacgtgtgcatgtgtctctataccagcatgatctatagtcctttgagtatatacacagtaatgcgatggctgggtcaactggtacttctacgtctagactcctgaggaatcgccacactgacttccacaatggttgaactagtctacacgtccaccaacagtgtaaaagcgctcctatcttcccacactctctctagcacctgttgtctcctgactttctaatgattgccattctaactggtgtgagatggtatctcattgtggttttgatttgcatttctctgatggccagtgatgatgagcattttttcatgtgtcttttgactgcataaatgtcttcttctgagaagtgtctgttcatatcctttgcccactttttgatggggttgtttgtttttttcttgtaaatttgtttgagttcattgtagattctggatattagccctttgtcagatgagtaggttgcgaaaattttctcccattctgtagcttccctgttcactctgatggtagtttcttttgctgtgcagaagctccttagtttaattagatcccatttgtcaattttggcttttgttgccattgcttttggtgttttagacatgaagtccttacccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtccaaagatcagatagttgtagatatgtggcattatttctgagggctctgttctgttccattgatctatatctctgttttggtaccagtaccatgctgtttggttactgtggccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttctttgtatcctcttttatttcctcgagcagtagtttgtagttctccttgaagaggtccttcacgtcccttgtaagttggattcctaggtattttattctctttgaagcaattgtgaatgggagttcactcatgatttggctctctgtttgtctgttatcggtgtataagaatgcttgtgatttttgtacattgattttgtatcctgggactttgctgaagttgcttatcagcttaaggaagttttgggctgagacagtggggttttctagatatacaatcatgttgtctgcaaacagggacaatttgacttcctcttttcctaactgaataccctttatttccttctcctgcctgattgccctggccagaacttccaacactatgttgaataggagtgttgagagagggcatccctgtcttgtgccagttttcaaagggaatgcttccagtttttgcctattcagtatgatactggctgtgggtttgtcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccgcttgatcatggtggataagctttttgatgtgctgctggattcggtttgccagtattttattgaggatttttgcatcaatgttcatcaaggagattggtctaaaattctcttttttggttgtgtctctgcccggctttggtatcaggatgatgctggcctcataaaatgagttagggaggattccctctttttctattgattggaatagtttcagaaggaacggtaccagttcctccttgtacctctggtagaattcggctgtgaatccatgtggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtgctgatatcccctttatcattttttattgcgtctatttgattcttctctctttttttctttattagtcttgctagcggtctatcaattttgttcatccttccaaaaaaccagctcctgggttcattaatgttttgaagggtttttttatgtctctatttccttcagttctgctctgatcttagttatttcttgccttctgctagcttttgaatgtgtttgctcttgcttttctagttcttttaattgtgttgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagtttcttaatcctgagttgtagtttgattgcactgtggtctgagagacagtttgttataatttctgttcttttacatttgctgaggagagctttacttccaactatgtggtcaattatggaataggtgtggtgtggtgctgaaaagaatgtatattctgttgatctggggtggagagttgtgtaggtgtctattaggtccacttgttgcagagatgagttcaattcctgggtatccttgttaactttctgtcttgttgatctgtctaatgttgacagtggggtgtgaaagtctcccattattattgtgtgggcgtctaagtctctttgtaggtcactcaggacttgctttatgaatctgggtgctcctgttttgggtgcatatatatttaggatagttagctcttcgtgttgaattgatccctttaccattatgtaatggccttctttgtctcttttgatctttgttggtttaaagtctgttttatcagagactaggattgcaagccctgcctttttttgttttccatttgcttggtagatctccctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatatcgttatgtgtgaatttgatcctgtcattatgatgttagctggttattttgctcattagttgatgcagtttcttcctagtctcaatggtctttacattttggcatgattttgcagcagctggtaccggttgttcttttccatgtttagtgtttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagaatcgctgttagtctgatgggcttcctttgtgggtaactgacctttctctctggctgctcttaacatttgtccttcatttaactttggtgaatctgacaattatgtgtcttggaattgctcttctcgaggagtatctttgtggcgttctctgtatttcctgaatctgaatgttggcctgcctcgctagattggggaagttctctttgataatatcctgcagagtgttttccaacttggttccattctccccgtcactttcaagtacaccaatcagacgtagatttggtcttttcacatagtcccatatttcttggatgctttgtttgtttctttttattcttttttctctaaacttcccttcttgcttcatttcattcatgtcatcttccatcactgataccctttcttccagttgatcgcatcggctcctgaggcttttgcattcttcacgtagttctcgagccttggctttcagctccatcagctcctttaagcacttctctgtattggttattctagttatacattcgcctaaatttttttcaaagttttcaacttctttgcctttggtttgaatttcctcccgtagctcggagtagtttgatcgtctgaagccttcctctctcaacttgtcaaagtcattctccgtccagctttgttctgttgctggtgaggaactgcgttcctttggaagaggagaggcactctgctttttagagtttccagtttttctgctctgttttttccccatctttgtggttttatctttgtttggtctttgatgatggtgatgtacaggtgggtttttggtgtggatgtcctttctgtttgttagttttccttctaacagacagggccctcagctgcaggtctgttggagtttgctagaggtccactccagaccctgtttgcctgggtatcaacagcggtgtctgcagaacagtggattttcctgaaccgcgaatgctgctgtctgatcgttcctctggaagttttgtctcagaggaatacccggccgtgtgaggtgtcagtctgcccctactgggggtgcctcccagttaggctgctcgggtgtcaggggtcagggacccacttgaggaggcagtctgcctgttctcagatctccagctgcgtgctgggagaaccacggctctcttcaaagctgtcagacagggacatttaagtctgcagaggttactgctgtctttttgtttgtctgtgccctgcccccagaggtggagcctacagaggcaggcaggcttccttgagctgtggtgggctccacccagttcaagcttccgggctgcggctgctttgtttactgaagcaagcctgggcaatggcgggcgcccctcccccagcctcactgccgccttgcagtttgatctcagactgctgtgctagcaatcagcgagactccgtgggcgtaggaccctccgagccaggtgcgggatataatctcctggtgcaccgtttcctaagcccatcggaaaagcgcggtattagggtgggagtgacccgatattccaggtgctgtctgtcacccctttccttgaccagcaaagggaactccctgaccccttgcacttcccgagtgaggcaatgcctcaccctgcttcggctcgcacacggtgcgctgcacccactgtcctgcacccactttctggcactccctagtgagatgaacctggtacctcagatggaaatacagaaatcacctgtcttctgtgttgctcacgctgggagctgtagaccggagctgtt

SEQ ID NO: 12730 - DNA, 4875 bp, Homo sapiens
ttctttttttttgtccttcctttttctttttcttttctttttcaaaaaaaattttttattatactttaagttctagggtacatgtgcacaacatgtaggtttgttacataggtatgcgtgaaccatgttggtttgctgcacccactaacttgtcatttacattaggtatttctcctaatgctatccctctcccagccccccaccccatgacaggccccagtgtgtgatattccccgccctgtgttcaagtgttctcattgttcacttcccatccatgagtgagaacatttggtgtttggttttctgtccttatgatagtttgctgagaatgatggttttcagcttcatccatgtgcctgcaaaggacatcaactcatccttttttatggttgcacagtattctatggtgtttatgtgccacattttcttaatccagtctatcattgatggacatttggcttggttccaagtctttcctattgtgaatagtgccacaataaatatacatgtgcgtgtctctttatagtagcatgatgtataatcctttgggtatatacccagtaatgggatcgctgggtcaaatgttatttctagttctagatccttgaggaatcaccacactgtcttccacaatggttgaactagtttacactcccaccaacagtgtaacagcgttcctgtttctccacatcctctccagtatctgttgtttcctgactttttaatgatcaccattctaactggcatgagatggtatctcattgtggttttgatttgcatttctctaatgaccagtgatgatgagattttttttcatatgtttgttggctgcaaaaatgtcttcttttgagaagtgtctgttcatatcctttgcccactttttgatggggttgtttgttttttttcttgtaaatttgtttaagttctttgtagattctggatattagccctttgtcagatgggtagattgtaaaaattttctcccattctgtaggttgcctgttcactctgagggtagtttcttttgctgtgcagaagctcttcagtttaattagatcccatttgtcaatttcggcttttgttgccattgctgttggtgttttagtcatgaattctttgcccatgcctatgtcctgaatggtattggctaggttttcttctagggtttttatggttttaggtctaacatttaagcctttaatccatcttgagttaatttttgtgtaaggtgtaaggaagggatgcagtttcagctttctacatatggctaaccagttttcccagcaccatttattaaatagggaatcctttccccatttcttgtttttgtcaggtttgtcaaagatcagatggttgtagatgtgtggtgttatttctgaggcctctgttctgttccattgatctatatctctgttttggtaccagtaccaggctgttttggttactgtagccttgtatatagtttgaagtcaggtagtgtgatgcctccagctttgttctttttgcttaggattgtcttggcaatgtgggctcttttttggttccgtatgaactttaaagtagttttttccaattctgtgaagaaagtcattggtagcttcatggggatggcattgaatctataaaattaccttgggcagtatggccattttcacaatattgattcttcctatccatgagcatgaaatgttcttccatttgtttgtgtcctcctttatttcgttgagcagtggtttgtagttctccttgaagaggtccttcacatcccttgtaagttggattcctaggtattttattctctttgtagcaattgtgaatgggagttcactcatgatttggctgtttgtctgttattggtgtataggaatgtttgtgatttttgcacattgattttgtatcctgagactttgctgaagttgcttatcagcttaaggagattttgggctgagacgatggggttttctaaatatacaatcatgtcatctgcaaacagggacaatttgactttctcttttcctaattgagtacccttcatttctttctattgcctgcttgctctggccagaacttccaatactttgttgaataggaatggtgagagagggcatccctgtcttgtgcaggttttcaaagggaatgcttccagtttttgcccattcagtatgatagtggctgtgggtttgtcataaatagctcttattattttgagatacattccatcagtgcgtagttttttgagagtctttagcatgaagggctgttgaattttgtcaaagtccttttctgcatctattaagatagtcatgtggtttttgtcattggttctgtttatgtgatggattacatatagtgatttgggtatgttgaaccagtcttgcatcccagggatgaagccaacttgatcgtggtggataaactttttgatgtgctgctggattcagtttgccagtattttattgaggattttagcattgatgttcatcagggatattgttctaaaattctctttttttgttgtgtctctgccaggctttggtatcaggatgatgctggcctcataaaatgagttagggaggattttctctttttctattgattgaaatcgtttcagaaggaatggtaccagctcctgttcatacctctggtagaattccactgtgaatccgtctggtcctggacattttttggttggtaggctgtttattattgcctcaatttcagagcctgttattggtctattcagagattgaacttcttccttgtttagtcttgggagggtgtatgtgtccaggaatttatcaattttttctagattttctattttatttgcatagagatgtttacagtattctctgatggtagtttgtatttctgtgtcatcggtggtgctatcccctttatcatctttattgtgtctatttgattcttctctgttttcttctttattagtcttgctagcggtccatcaattgtgttgatcttttcaaaaaaccagctcccagattcattgattttttgaagggttttttgtgtctctatctccttcagttctgctctgatcttagttatttcttgccttctgctagttattgaatttgtttgctcttgcttctctagttcttttaattgtaatgttagggtgtcaattttagatctttcctgctttctcttgtgggcatttagtgctataagtttccctctatacactgctttaaatgtgtcccagagattctggtacgttttgtcttcgttctcattggtttcaaagaacatctttatttctgccttcatttcgttatttacccagtagtcattcagaagtaagttgttcagtttccatgcacttttcaggatttgagtgagtttcttaatcctgagttctaatttgattgcactgtcatatgagagacagtttgttgtgatttctgttcttttacatttgctgaggagagctttgcttccaactatgtggtcaattttggaataagtgtgatgtggtgctgagaagaatgtatattctgttgatttggggtggagagttctgtagatgactatttagttggcttggtgcacagctgagttcaagtcctggatatccttgttaactttctgtctcgttgatctgtctaatattgacagtggggtgttatagtcttctgttattattgtgtgggagtctaagtctctttgtagttctctaatgacttgctttatgaatctgggtgctctggtattgggtacatatataattaggatagttagctcttcttgttgaattgatccctttaccattatgtagtggccttctttgtctcttttgatctttgttggtttaaagtctgttttatcagagactaggattgcaacccctgcttttttttttgttttccatttgcttggtagatcttcctccatccctttattttgagcctatgtgtgtctctgcacgtgagatgggtttcctgaatacagcacactgatgggtcttgactctttatctcattggccagtctgtgtcttttaattggggcatttagcccatttacatttaaggttaatattgttatgtgtgaattagatcctgtcattatgatgttagctggttattttgcctgttagttgatgcagtttcttcctagcattgatggtctttacaatttggcgtgtttttgcagtggctggtactggttgttcctttccgtgtttggtgcttccttcaggagctcttttagggcaggcctggtggtgacaaaatctctcagcatttgcttgtctagaaaggattttatttcctcttcacttgtgaagcttagttggctggatatgaaattctgggttgaaaattcttttctttaagaatgttgaatattggctctcactctcttctggcttgtagagtttctgctgagagatctgctgttagtctgatgggcttccctttgtgagtaacctgacctttctctctggctgcccttaacattgttttccttcaattcaatcttggtaaatctgacaattatgtgtcttggggttgctcttctcaaggaatatctttatggtgttctctgtatttcctgaatttgaatgttggcctgccttgctaggttggggaaattctcctggataatatcctgaagagtgttttccaacttggttccattctccctgtcactttcagtttcaccaatcaaacgtagatttggtcttttcacctagtcccatatttcttggaggctttgttcatttctgtttactcttttttctctaaacttctcctcttgctttatttcattcatttgatcttcagtcactgataccctttcttccacttgatcaaatcggctactgaagcttgtacatgcatcatgtagttct

SEQ ID NO: 12731 - DNA, 6198 bp, Homo sapiens
tttctattccattatttttttttattgttttattttttattttttattttattattattctactttaagttttagggtacatgtgcacaatgtgcagtttagttacatatgtatatatgtgccatgctggtgtgctgcacccattaactcgtcatttagcattaggtatatcttctaatgctatccctcccccctccccccaccccacaacagtccctagagtgtgatgttccccttcctgtgtccatgtgttctcgttgttcaattcccacctatgagtgagaacatgcggtgtttgggtttttgtccttgcgatagtttactgagaatgatatttccaatttcatccatgtccctacaaaggacatgaactcatcatttttttgtggctgcatagtattccgtggtgtatatgtgccacatttttttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatctcatttgtcaattttggcttttgttgccattgcttttggtgttttagacatgaagtccttgcccatgcctatgtcctgaatggtactgcctaggttttcttctagggtttttatggttttaggtctaagtttaagtctttaattcatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggttgtagatatgcagcattatttctgagggctctgttctgttccattgatctgtatctctgttttggtgccagtaccatgctgttttggttactgtagccttgtagtatagtttgaagtcaggtagtgtgatgcctccagttttgttcttttggcttaggattgacttggcaatgtgggctcttttttggttccatatgaactttaaagtacttttttccaattctgtgaagaaagtcattggtagcttgatggggatggcattgaatctataaattaccttgggcagtatggccattttcatgatattgattcttcttacccatgagcatggaatgttcttccatttgtttgtatcctcttttatttcattgagcagtggtttgtagttctccttgaagaggtccttcacgtcccttgtaagttagattcctaggtattttattctctttgaaataattgtgaatgggagtttgctcatgatttggctctctgtttgtctgttattggtgtataagaatgcttgtgatttttgtacattgattttgtatcctgagactttgctgaagttgcttatcaacttaaggagattttgggctgagacaatggggttttctagatatacaatcatgtcatctgcaaacagggacaatttgacgtcctctttcctaattgaataccctttatttccttctcctgcctaattgccctggccagaacttccaacactatgttgaataggagtggtgagagagggcatccctgtcttgtgccagttttcaaagggaatgcttccagttattgcccattcagcatgatattggctgtgggtttgtcatagatagctcttattattttgagatacgtcccatcaatacctaatttattgagagattttagcatgaagggttgttgaattttgtcaaaggccttttctgcatctattgagataatcatgtggtttttgtctttggttctgtttatatgctggattacatttattgatttgcgtatattgaaccagccttccatcctggggatgaagcccacttgatcatggtggataaggtttttgatgtgctgctggattcggtttgccagtattttattgaggatttttgcatcaatgttcatcaaggatattggtctaaaattcttttttttggttgtgtctctgcctggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttacttgtgtagaggtgtttgtagtattctctgatggtagtttgtatttctgtgggattggtggtgatatcccctttatcattttttattgcgtctatttgattcttctctcttttcttctttattagtcttgctagcggtctatcaattttgttgatcctttcaaaaaacaagctcctggattcattaattttttgaagggttttttgtgtctctatttccttcagttctgctctgattttagttatttcttgccttctgctagcttttgaatgtgtttgctcttgcttttctaattcttttaattgtgatgttaggatgtcaattttggatctttcctgctttctcttgtgggcatttagtgctataaatttccgtctacacactgctttgaatgtgttccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatactgagttctagtttgattgcactgtggtctgagagatagtttgttataatttctgttcttttacatgtgctgaggagagctttacttcgaactatgtggtcaattttggaataggtgtggtgtggtgctgaaaaaaatgtatattctgttgatttggggtggagaattctgtagatgtctattaggtccacttggtgcagagctgagttgaattcctgggtatccttgttaactttctgtctcgttgatctgtctaatgttgacagtggggtgttaaagtctcccattattattgtgtgggagtctaagtctctttgtaggtcactaaggacttgctttatgaatctggatgctcttgtattgggtgcacatgtatttaggatagttaattcttcttgttgaattgatacctttaccattatgtaatggccttctttgtctcttttgatctttgttggtttaaaatctgttttatcagaggctaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattgaagcatttagtccatttacatttaaagttaatattgttatgtgtgaatttgatcctgtcattatgatgttagctggttattttgcttgttagttgatgcagtttcttcctagcctcaatggtctttacaatttggcctgattttgcagtggctgataccggtttttcctttccatgtttagtgcttccttcaggagctcttttagggcaggcctggtggtgacaaaatctctcagcatttgcttgtctgtaaagtattttatttctccttcacttatgaagtttagttggctcaatatgaaattctgggttgaaaattcttttctttaagaatgttgaatattggcccccactctcttttggcttgcagagtttctgccgagagatctgctgttagtctgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcacatcggcccctgaggcctctgcattcttcatgtagttctcgagccttggctttcagctccatcggctcctttaagcacttcactgtattggttattgtagttatacattcatctaaatttttttcaaagtttttaacttctttgcctttggtttgaatttcctcctgtagctcggagtagtttgatcgtctgaagccttcttctctcaactcgtcaaagtcattctccgtccagctttgttctgttgctggtgaggaactgcattcctttggaggaggagaggcactctgctttttagagtttccagtttttctgctctgttttttccccatctttgtggttttatctacttttggtctttgatgatggtgatgtacagatgggtttttggtgtggatgtctttctgtttgttagttttccttctaacagacaggaccctcagctgtaggtctgttggagtttgctagaggtccactccagaccctgtttgcctgggtaacagcagcggtggctgcagaacagcggattttcgtgaaccacgaatgctgctgtctgatcgttcctctggaagttttgtctcagaggagtacccggccgtatgaggtgtcagtctgcccctactggggggtgcctcccagttaggctgctcgggggtcaggggtcagggacccacttgatgaggcagtctgcgtgttctcagatctccagctgcgtgctgggagaaccactgctcccttcaaagctgtcagacagggacatttaagtctgcagaggttactgctgtctttttgtttgtctgtgccctgcccccagaggtggaacctacagaggcagtctggcctccttgagctgtggtggtctccacccagtttgagcttcccggctgctttgtttacctaagcaagcttgggcaatggcaggcgcccctcccccagcctcgctgccgccttgcagtttgatctcagactgctgtgctagcaatcagtgagactccgtgggcgtagaaccctctgagccatgtgcgggatataatctcctggtgcgccgttttttaagcccgtcagaaaagcgcagtattagagtgggagtgacccgattttctaggtgctgtctgtcacccctttctttgactaggaaagggaacttcctgaccccttgcacttcccgaatgaagcaatgcgtcgccctgctttggctcgcgtacggtgcgctgcacccactgtcctgcgcccactgtctggcactccctagtgagatgaacccggtacctcagatggaaatgcagagatcacctgtcttctgcatcgctcacgctgggagctgtagaccagagctgttcctattcagccatattggctgcccc

SEQ ID NO: 12732 - DNA, 22713 bp, Homo sapiens
aaaagttttgtgagagctttaatggcacaaaatgtttatagctacaagttatacatgtattgtaaactgtatataacgatacaaagtgctaactaaaatagatgaagaatgcataatcactttggctcagttaattccaataatttccacaacgggttcatgaaaaaacttatctgactggctaagtcttcaattctcatttttttagaatagtaaatatttttactgcaatcacgggaacttgttgcactttccaatgtgcaagtttgtgcagttttgctcttgattctatttacaaacatcttgagccagttttcatcaaacatatgaaaaatgaagcctgcctttttgtccccaaattgtaaacaggtgtaaagctttttaaacattaacctcacaatttcaactattaattgttgaattctcctttccaaaccacaatgttttcgttcaacacaaatctgggtgtagcagtaaaacgttcatcccatgtgttagggctacagatacatactacatgctctcataataaattctactgtgatgatgtattcacgttttaagtaattttccataatttcactgatgctttaagaaaaagggcaacactatgtttctttttaacgctgaaagaaatcataaatatacccagtttcagtggcaccactgatagaactgctgctgaacttggaaagagcacaatgcactagctgtaagaagtcactttcaggtaaagtgtaattttacttttcccccctgtaataccaattgtaatagaaattgcatactgtagcagtttagctagtcagttctcctaactttccagtctttccaattttattcaggcttttcaaaaatcagtgagccatcagatttactttcttcccaaagaaattcaaatatgaacacttgaaataaataggttatagaaggcaaatcaagtgttaccaggtttaagagtaagacagaaacatggtctaggaaaaagatgtccaaaattatttagacatcaaatgctagaaagaaaaaagaaaattactttcaaacctagaatatatcatctttcttaaagatagccagctatatttcttgaaaaaagataaaaattttgtttaatctatatgttattttccactataacacatcaattttacaaatgttgatgtgagaaaagagttagtttctgcaaactggcaaacctgtctgtcatagtgtttttattcaagttgacctggtgcactttatagattgctagttttaaaattaacaacggttctctaaatagtcaatatcaatgtctatatcataaacagtaattatttatatataaaacatgtggtatccttcagagtcatgctagatgttctgaaatccaagaaaatctactcgagataactggtcatcctgatgctttctaacaatttggtcctaaagcttcacattttagaaatgaacgaacaagtatatcactgaaggaatctgttgagtgttctgaactttaagagtttaccataactgaaaagacagctacatgagaaaatgaccagtgcctgcagtcgcaggaatcaccttgggaagactgtacagtaaacattattcagtgagagatcagaaggaaacaaatggcatcttttcagaacgctgtcaactgttcccacaacccaagtctgtttttccaagttgcacaagtgcttggaataactctgaaacaattctcttcagagtttaaaggcttcagagtataggtgatgcttcctaaaacaagaagcctgtattaacatcacaaattggaactcattccaaagcctcttcttagagaaaaaaaaataaagaaataaaaaataaaaaatgtaaagaaggtcatgaaaaattcacatgcagctaattatcgtaaaaaatatcaaacacacacgcaaaaatctcaaaaagcaatttcatatatttctaagcctgagacgttccttatcagaaagaaagattctacaccatagaaaagacagcattacaacatactagtatgaaaatctgctgatgtattttacttcttattctatttcatacctatcatttatacagtttgcctcctataaattaaaagacgctattaggaggcttagacaaaaaagtggctccaaagctggtttaaaatattttttttattgcccaggatatttttttgttgtgccttgccttttttttttgttttgttttctttttaataactatcaactcaaacttagggaaacttgcctttgtcttgggggaaaaaaaacaactagacaataaagcttcttttacatcatttgctaacctgatctcgttttaagagagagatggtagttatgttgcaagagtaaaatttataccatgaatgatacaggtctagtctggtggcactaattagagataatagcattgctgacaaaattataatctgctggtggcatttgcggaaaagaagcccttgcaaatttctaaacaacagtaaactctgttaggaaattctaaaatgtcttcaggccaaaaagggtataaggttagtaaaatgcctcaacagagtttgaataaaatattgaatttgagagttactggaattggatatgtaaaaacagggtggtaggttgggtcatgcttacaatggtctcaagttcaaataagctactgtgacaatacaccacttcacaggtcacacgcatttccaggggcttttcctttccctcagtaggtgctggcagagggtgtgctcagtcgctttccaatatagatgctgaaaggaagcagaagcatcatgtttcacctgtttcaacagttctataccagcttgtccacaggttgaactctacttaaaactcttcagtctttgtaaaaggctctaaaggtttgtgggtaccgctccccaaacaccgtgaaatcatcactgactttcttaaaaccagtcaccagcccggccaaactggttttatatgagtttgtttactcattaaatatcggggctcgacagcaaaggggtagtgattagacaaagtaaagccagagagaacagatccctccacagagtaaataaagcagcccaactccttcaagatgttcctctttggtggacagaaggttctactgacatttcagacacaaaaatatagtaatatgtgaaattattctggtgctctatgtaggacaaaagaaaaaaaaaaccttaaaagctgccagtgctttaaagacagctcttactaataactcctaaggattaggggccttataatactttttcatgccaagaaagtatttggcctcttcaacagcaaaagcagaagggaagttaaggaaagtatgtaactagcttcacctccagtgcaattaaagcaacgaactttttaaacactctttttacattcatctatagcaatagttatacttacagccaagacaaacaatctgaagatgactgaaagagagacggcaaggtatagacaccaatcgcttaagggcaatgaactgctgtataggcagcaatgtattaaactcctacacctgccccacatcaacccccacgcaacagtcacacagtccccttctgcacaaaccccttctaggttgctgtttgttgattactgtccttgccctcacaaaagcagatcaagcacccaagagagacaagacgggtgtgtggaaagctgtatgcaagtttctgaggtcgtgactaagaatctctctccaatatgctgagctccttaaagggaagaaaaaggatgaccccatcttctgcatatcttatactgaaaatgacccactgggcatgcttagagcacaacatacgtcttgaaaaaaattaacagctactgtttaactcctaaaatctttcagaagtgtaattcctcaattgtttaaatcaaggaaaaaaagcaatttatttaaaagatgtggctaagaaactaatgaattacacgtaaatatgaggttgattttagcaaaataaatgaaaatactacaaagttaaaaaaggaaaaaattagcaccaatcaacctaccagtttcattaaaaaaaactattcaatgtaatcatgtattttcccatatgaaaaaaaggtatttgcactgaccacaaaatgtacatgctaaagattagtttagttcataaattactcaagattaaatattacacaacaaaacccaaaaagaaaaatcaatcacagaggagtccgcttacatttgatcatttaggggattattatgaacatcttcttttttttttttttttttccgagatggagtctcactctatcccccaggctggagtgcagtggcatgatctcggctcactgcaatttccgcctcccatgttcaagcgattctcctgcctcagcctcccaagtagctgggaccacaggcatgtaccaccatggccagctaatttttgtatttttagtagagaccgggtttcaccatgttggccaggctggtcttgaactcctggcctcaggtcatccacccatcttggcctcccaaagtgctgggattactggcatgagccaccacaccaggccaaacatcttattttcaaataagaaaacacactctactattattaaaaatgcttatttgtagaacaattgtgcacccacttttttaagttcaccttatttgcactaaaacattgaaagtaaagcaataaaaactgctttcacatacatttcttcaatctgaaaataagaggataaaatgaatggaaaaaacttcaggagttgaccggtacttaccctagccccaaagccaaaacatgagaaaggaagagagatggaatgaacaccttcagaaattctgcggagaaaataccccctttcttcatggctccacttttcctcatgcttaaagacacagaacgtttagggtgtctgaagtggaactccctgagaaagaaattcagaggcagatgtcatttgctgaaaatatcgtggggattaccaggcccattgcctgtaagcgtgcgcagatcaactgtgtccactgacaagaaacatgtgagaactcacttgggtggaatgttttcgggtctactggaccagtctgatacccagtccgcacttttcttcaaagcctcgacttccttctctccttctacaacttcttcttctgactgtaaagaagaattcaaactttaagaaaaaaaggaagaccaattcctcctaatacaaagaaaaatctagacagaaaagataccaaactcataaggttgtgtctcagaaattttagataacaaacatgttgcttttctaaaaaatgctgaaaaataatgtaagatcagagtatgtaatatcttcagaacaacctgagtgagcttcactgttgggatatctaagcacagcacaggaactgcataagactgtactttgggatgtaatgctaagggaagtatgaaaaacctcgataagagttaaatctgggcaatacttacatggaggtccattatattattctctcttgtatgcacttaaaattttcgtaattaggccgggtgcagtggctcatgcctataatcccagcactttgggaggctgaggcaggcggatcacttgaggtcagaagctggagaccagcctggccaacatggtaaaaccccgtctttactaaaaaaaaacacaaaacttacacgctgggtgcggtggctcacgcctgtaatcccagcactttgggaggccgaggtgagcggatcacaaggtcaggagatcgagaccatcctggctaacacagtgaaaccctgtgtctactaaaaatacaaaaaaattagctgggcgtgatggcgggcacctgtagtcccagctactcgggaggctgaggcaggagaatggcgtgaacccaggaggcggagcttgcagtgagcagagatcgcgccactacactcctgcctgggggaaagagcgagactccgcctcaaaaaacaaaacaaaacaaaacaaaaaaaaattagccgggcatggtggcgggcacctgtaatcccagctacttgagaggctgaggcagaagaatcgcttgagcctgggaggtggaggttgcttgagcctgggaggtggagccgagatccagccactacactccagcctgggtgatagagtgagattccatctcaacaaaaaaaagaaaaaaaaaaatttcataattaaaaaaataaaaggaaataaaaggatatgctaaaaataaaatgatgagaagtaaaacaaaaataagtgagagatgtgatgaggaaataaataatagtatttattgagcacttaaaggggcaaatattattccaagcatgttacatgcattttttttttttttctggagacagggtctcctgtgtcacccaggccagagtgcaatcacagcttactgcagcctcgaactcctgggctcaattaattctcccacctcaacctcccaagtagctgggactacaggtgtgtgccaccacgcccagctaatttttgtatttctttaaagagacagtgtttcactatgttgcccagcctggtcttgaactcccgggctcaagggatcttccctgcctcagcctcccaaagtgctgggattacaggtgtgagacactgcacccagccacatgcattaactttcaccttgcaacaaataaccctataaaaataattattaaaatcccattttacagatgaggagactgagacatagattaaataacttgcctaaggttccacaaccagtacatagcagggccagtattcaaacccagaatactgtatagagaggccctactgttaagcaccagggtttactctctggaaggagattatatttttaggacaaattgctatacaaacattttccaaggtttcgaaactatgttagccaaaagtttttgggaataatctataataagttgagtcagaatttaacatgtgtcatatcaaataaaataaaaaatgtgacttttaaaaattgcttattataactaaagtttcaggccaagaacaattaacatttccaatagctccccttttaatagaaccaaaaggaatgaaaaagtcctaaaaatgatatttatttattcagtattatttattcagttttctttttgagacggagtctcgctctgtcacccaggctggagtgcagtggcgcgaccttggctcactgcaacctctgcctcctgggttctagcaattctcctgcctcagcttccagagtagctgggattacaggcgcctggcactacacctggcaaatttttatatttttcgtagagacggggtttcaccatgttggccaggctggtctcgaactcctgacctcaagtgatctacacgcctcagcctcccaaagtgttgagattacaggcgtgagccaccgtgcctggtcatagtcagttttaagggatgtcatgctatgatcccaaacccaggggtctcaaaactaagaagcattttgacattttattttgtttgactaggattcactcaaaagaatgaccaaagctgtcattcttttcagtaggtagctaagaaatgcagagtctgacatattcacatgactcttgacaggtctagttctctgtgaaacagctaccccaggaaggagcttcagacagggcaaagtaaaacccctgtgcgttctgctgctcttgttagtaccaatcttatctagttctgctgaacttggcaaattccactgaatgacacaatgtagcatttaggattaagctccttccattggctattgagattactcagaatcatgagttggctctttggagtaacactgaaatcatcccaaatcaaaaacaataaactgttacaatttacttgcacatcagttcctgtacacacaatatctgactatactcaacacactgcaggtcgcttctgtttagtttcctgctttggcctcacagatctttctttaaacctgctcaaagatttaacaagttaatatttcataatttctgacagaatgaaacgcagtaagatttcacgctctaattttttttttcatgaggatggaattttctcagttgaatgaagcaaagttatctctggacaagtgttttaaaaagaaaacaaaacaaaaaagaactccataagtttcccaacttacaatactttaagaataagagtggtaagctttcctcattcactaccactctgtgcttccttttattaatcttaaatttgccactttcaggttttaaactgccttccaattcttagaattccagaatatggtaaaaatgtacttaatctaattacgtaagatttgtgcttttaaaatcaataatcctctctctatacctacatctattcaaagaagattctggctgggcaccatggctcatgcctgtaatcccagcacttagggaggccgaggtggacggatcacttgaggttaggagtttgagaccagcctggccagcacggcgaaaccctgtctctactaaaaatacaaaaattagccaggcgttgtggtgcacacctgtaatcccagcttcttgggcagctgaggcagcagaaccacctggaaacagaggttgcagtgagccgatgccactgcactccagcctggtgacagagtgaggtccatctcaaaaacaaaaaacaaaaacaaagaagattctgatcgttctagcctgttctctcacatggagttctttgttttctgatcacttaagtttttcttctctggtttacctcaaggtcactctgtcctctaaatatggatattaagctgtataccatgattcatgtacagataaaaatcacagttttacaagacaggaaatggaggatattttctgtttggatcatttttcagtaacactcaacattgtgctggcatttttggtcccagaaacacaatgcaaaaatgtcttcaataaataatctatatcgcttctcggacttttggctaagatcaagtgaagaaacaatctacagtctgttttctgatacaaaactgagactcttgaggatgatcatccgaaaagcagtttcatggtctttttcctaagtgcacactgccttaggcagattccccataccataactcagcagacatttttcagttcattctcatggctttgtgagctctcctgttatcaatcgaattcatttacttagttcagtagaaagaacaagggccacagactcagacctgctttgaatcctggctctaacagtgacttgctttgtgatcttagataagtaattagtacaaagcctcactttttccactggtccatggggataatatcattgctttcactggattgagaacattaaaagagaggtgggagtagtaactcatgtctgtaattccagcactttgggaggccgacatgggaggatcatttgaggccaggagtttgaaaacggcctgggcaatatagcgagactctgtctatacaaaaaaaaaataaaaaagtagccaggcgtggcagtgtgagcctgtagtcccagctactagggagactgaggcagaaagattgcttgagccgggaatcgaagtctgtggtgagctacaactgcaccactacactccagcctgggtgacaaagcaagaccctgagacgctgtctccaaaaaaaaaaaaaaagaaactgagtacctagaacatatctagttaatgttagtgactttacttcctcatcttagaaaagcttgaaaattatatatagtccttataaacacatataaaaacattctataagatcaagtacaataacagtcctttaactgcttttttaagtttcctaaccctaaactttcttcttattcaggaagaaaatcaattttcccaaatcctaaagaaattaatttttaaattattgtttcttccattaaaaaaaggcaatgtcaaaggtttttgaaagtttaaactatacctgctgacagctcccttattaagtcctactcaactgttatctctcacaggggttaggctgtctttccaaactcttccctttgttgaaactgaccgatctgattgtcaacataaagtaagtacctcctcttgatgatagcctatgctcttttagggatttggtcctgagaagggatcaacactggcaaacctaccaaaggccaaaaacctgacattttctttcctgaatttcaaaaattcctttggaattccagggtagatgcattcaactctagaattccatgtacattcaatattgagttaagcctgattgcacatctgcaactccatgagccaggaaagcacttaccacagtgctccacggagttattaagttcttaagggaaaaacgtatgcagagaagaggaagaaagtctaaggtcaaataagcttgggaaacatttggtttaattaaacccatttctttttttcttttttttagagacagagagtcttgctatgttgcccaggctggactcaaaaacttgtggggctcaagggatcctcccacctccacctcccaagtagctgagactacaggcaagtgccaccatgtccagcttaaactataatttctttactgcaggaactggtcagaattactcatgcgactactaaggtgagagtgtgggggaacctggggctgcattaccttccatttatttgacctttgaacaaatgttcttgaaaacacattttggaaaatgctaatctaaacttaaagctttctgtataaaaggtgatatagattgaagaaatcctcctcaggaaagaccacggcaaagaattcgatttctctcctggattccgtggtacactttctgctatggagactttgtaagctttcttctacatcagctatagcttactgcatgtggccaaactgacatacataagccagcaattcaaatgctccagtcagatcatcttatatacgacagcctgctattgtgagcttctctacagtataaagctcatcatcataaaataaatttgtgttgaatccaaagattttcgacatttcagagaaaagcaaaaatagagcatagtaaagtatagaggaattctgtggcctttggaaacagaaagaatactgggtggatctaagacacacaaaatatttctagtgcccaggacacagaatagtgagaacccgacaaaacaaggtttttgttgcgactcattcaaaggttcattaaacatttttcaagcaccctaaatacaggagaaaaagataatggttcccgtcctcaagaatttgtactctaatgacacttttaggtgatcttacatatcaataaagttaaaggctggctatgagtattctaaatcattagccacagttatatacttaccatattttaagtcttataacacaaacatttgtaagattttaatactatatccatctatgtttccaacattgtcaactcctagtaaacaatatttatcttgaaggaatcctgcataatttagataaatttaaaatttatctcaaaagccactgctttgatttcagatgcaaaaaaaagtcttcatgtctagttctaatacaaccttcatcttcatttattctgtggtctttttttttttttttattttgtacctccactggtaggtttttttttttgttttttttggggaatttaagttttagggtacatgtgcacattgtgcaggttagttacatatgtatacatgtgccatgctggtgtgctgcacccactaactcgtcatctagcattaggtatatctcccaatgctatccttcccccctccccgctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcatgatttatagtcatttgggtatatacccagtaatgggatggctgggtcaaatggtatttctagttctagatacctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacatctcatagtggttttgatttgcatttctctgatggccagtgatgatgagcattttttcatgtgttttttggctgcataactgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgtagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaagcggcgttatttctgagggctctgttctgttccattgatctatatctatgttttggtaccagtaccatgctgttttggttactgtagccttgtggtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcactgaatctgtaaattatcttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctcttgttggtgtataggaatgcttgtgatttttgtacattgattttgtatcctgagactttgctgaagttgcttatcagcttaaggagattttgggctgagaaaatggggttttctagataaacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttacagaggattccctctttttctattgattggaatagtttcagaaggaatggtaccagttcctccttgtacctctggtagaattcggctgtgaatccatctggtcctggactcttcttggttggtaaactattgattattgccacaatttcagctcctgttattggtctattcagagattcaacttcttcctggtttagtcttgggagagtgtatgtgtcgaggaatgtatccatttcttccagattttctagtttatttgcgtagaggtgtttgtagtatcattttttgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgctagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagacgtctattaggtctgcttggtgcagagctgagttcaattcctgggtatccttgttgactttctgtcttgttgatctgtctaatattgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattgcagaatttagtccacttacatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcagttttcaacttctttgcctttggtttgaatgtcctcccgtagctcactctaatttgatcgtctgaagccttcttctctcagctcgtcaaaatcattctccatccagctttgttccgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctctgtttacctaagcaagcctgggcaatggcgggcgcccctcccccagcctcgctgccgccttgcagtttgatctcagactgctgtgctagcaatcagcgagattccgtgggcataggaccctccgagccaggtgtgggatatagtctcgtggtgcgccgttttttaagccggtctgaaaagcacaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcatgctgggagctgtagaccggagctgttcctattcagccatcttggctcctccctattctgtggtcttaaagcatctatctcagtctttttctacttatacactcaagaaactagcctggagtattggcatgatttattatggacaagaattttccaattcgtttagagtgacagggcccaaaatccttagttgtaaaggagtgcgacaagaactatatcatcctaaataaattccaaaatcagaaactcaataatagcttcaaactattcctaaaagtcttcacatttattttagcaaaatatacttagagaatttacatctttcttaattgtttactgtaaatcagaatccccccgacacacctgagagctatggtccctgctggtgtgcatttccacatcaaacatgatctgcccatcttcttgtggcgaagggctagaagagaaggaattcagctattagttttaattctcactttgtcaaatgacttagtctctactagaaattagaaaattaaaagttacagcagtatggctttgaaaaagcaaatcagagaatatatcataaccctatacaagaaaaatttatgtgatattaaaaggctaaatgaaattgagcattcttactcccaaaatgttctgcactttttcagtagtaatgaaatccttcaaaatgataaatttgcaaaggaaatactatctacagacacaaactgtcacattctcttatatttactcttttgtccactaaaggtaaaataatcttcaaattcaggaacttcagagttctttttctcaaagttccctcatcattaaataattcaccagtagttctcaaagtgcataaggtagttctcaaagacgctttcagagggtctttgaggttacagttcctttctcaatactagtaggatttatttgcctttttcattctcattctcccatgtgtatagtggaattttccaaaggctacatgatgtgtgatagcacaacagttagaatgcaaacacagatgagaaccagctgtcttctattaagcttggtattagagatttgtaaatgtgtaaaacaatgccactattcttattaacttggagggtttatagaaaataggtattttcactaaaaaatgctacttatgttaaaatgtattatttttgaatgaatatatattttctcagttttaatttctaatatagtaaatatcaaaatatataaacccacaaacaagttttttggggtccctaatgatttttaagaatgtaaaggtatgtaatgaccaaaaactttgagaaccactattttacttatttcagaaatatttgctttgagatatttcagagtgaattatataacttatatattaatataaaacctttatgattgcacaaaatacattcttagaactgtaaaaatttacaaataagtttttagacaaaaacaacatgatcacaaactgcacttgatacaagagatgaacagaatgtgctaagttaatttcttagctttattaatgatttcttgtataaaaactgaaagtcactggggatccttcactacatacacaaaccctcccccaaaatctaaaatagaaataaaaaatatttggggcttaacttgctgaaaagaatagatattaactattaaagttatcaagagtatgtatataatgttaattaatgtatagagacgttggtgagactgactcagaaataagatcgtcagaaatttatcagacagattaggcctaggagtcttttagactagtataattgacataggagatttttaaatggggacaggaaaacagaaaagctggttctgtatcaaaccaacgtcatatatatttaggaaatttttgtcttgaactagcacaggagtcaacccgaactgggcactcctactggcctcagtttactatctttgtgctcataactgttgggttcacagctacacatcaagttaagggtcagccttacatagccgtgaccaggtcaaggcagtcagggtgacaaagtcaagaatcctatggaagcattgctctgcttctatatgcttcttcacactggtaccaacctcttctctaaactgtttactcctcctaacaatttggaatgcattagagcttcacccatggcacatattagaatcggctggggagcttttaaaatattgtgacgtctctaccctgcccctgtcaaccaaaatgagaagttcttgagatgcagtccatgtgctgccatttttaaaagctggtgggtgaatctagtgtgccgtcaaggtgaaaacccctgtgacagggtgaaaggcaaagcagaacacactggggttcccagctaacaacccctgcggcaacacaaatatttctatggaataatttttaagttgaaaatatacataaatcagctctaggactgatacccaacaaccctaaaacatttccccctacaagaaacactttccaattacttttcacatatagagacgcatggcaattcagatgatgtgagttttgaagacactcctcaatggtaaagcgtgttagtaggctatcccagaagactcgagttctagccattctctgaaagatgaccactaatctagggcctggagagacataagatgaggggtacgaaagtgttcaaaagcatttgccatgcctcctcatggcaacctaaacttaaacatgatcataggagggtgaaggcatattcagtcacacgtaaaactgcaccataaatgaagtaagatgaacagacaggtaagcaggtgactgttctctgctcattgacagcaccatgtgaacaacaggctcatggacaccatggtatcaatgatcaaggcccacacacctgaacgcagagtgaaagccttgttgacaggccataacaagcagaaaacttgagaaacccatcagcaagttccataatataaatataaatcttcattcggaaagacagactaatgctgtagctactggaatcaagggcaagctgttcagaagagagccatctgctctggttccgcttatgacaagagccatcccaggctctaagaagcacagggacaagtcagggatgacacgggggtggcgggggtgcacagtgtgccacagagccaacaaaccagtcccccgctgccttggcaacattagtggatcataagccactcaggaagttggacatgatttaactcatttctcctttttttcacttcttctgataagtaataatatgtgcaatatacacaatttttacaaaatacaaaaatgttaagaagaaacatatccatactgcattcctaaaaatagtcactgtttacatttccttaatctgcttcccgtgcatttgcattttctaaatggttaacatcagttaacaaccacccagaaggtcatccagtgccccataatgctaacagtgtagctgtcactgaaacaagaatttcttaaatgtcatttaatatctagcccttctgaaaaaaaaaaaaaaaaacagaaaagtttatactaaaaaataatgacctggtttcattccacacacatatctcgttgtattcttactctttcaccataagcagtccttaatccatgtaattagtttcttcagctcaaatatagaaaaatgaggtctgaaacaaaacatcccctgagaaagcagaggagacttcaaaactatctttacagaccttggttggtgcttccaactgtgcaaatattgctataacgtgaagcaacctgcagttcctatgaatcaaacatttactgagtgtctactacgtgccagcaccattactgtgaaggtaataaaaattaaacatggcccctgccctttgcaacgtcaacatctagaagggaagacacatatatacagaggtaactaattcaagaacagtctgtgatctgtaacacagggacacaaaggaaaatgggggaaagtcagattaattctataaattagcatttatgccactgaattttaaactgataaactgctagaaccaatataatctgggtaagaaaaatgacaatctggggaaaaacagtgggcactgaagcacctgtcaattagctgtctcatataaacacaatatatatctgtgcaatatatattatactacaatatatcaggaggcatattttgctaagtgaagatttaagcaaacagatttttcctagagtgaatgagccctgtaacccacctgtttcctgaattccaccaaaacatgggtctcacttacctgtcacagtgagaactgcctctggaactactctgtcctgattcatgttgtgcatccaaaagaatcttctccatgtctccattgtggatggaggatgaggatggtacgtgttccagccccccatttttcccattgccattatcattgccattgctgctgttcatgggtagctccacccaggaacctgttggacaagtcagataagttaaccacagcagaactgaaatctgtcatgtgcacacagatgtgaacatggtgaatccagataagaattctgactctcctcaaaccaaatgtaaaagtattctgaagaaaataaataagaagtaataaaagtctaaagatctatatagttctgttcctgaaatagctcatgccatcaactgagaaacagctcaaactctaaaacatctcagaaaacgtgtttttcagtcaatttctctctgggtaaagcttggtttataataacactctactgaaaactcaggttgcttttcaaaaaaaaattgctacttttaggctatttacctttaacattttagttggtgtatatatacacacacactttcttcatagtctacctaagctgctcagctgtatctgctccagaaatgaaataaatatatcacctacaaatttcataaaaggtcatctaagtaagttagcaactatatcctacttagtgcaaacaactgagaaactcctagagagggaacctaaatccaatagcaaaaatttcaatttgtgcacaaatcaggagcataaaattaatgcagctggttaactaaatcaggtaataatgctaaaaattcagaaaaaagctttatctctatctcactgattagtttcttcatttcctttgtatctcaggctttctagtccttctccttttttatacactaaacataccttgtgaacttgtcttttttcttttctctcccacgggtttctactttctagggttttcattaaaccctgttgatttgggagcagaaacaactgcacatcagc

SEQ ID NO: 12733 - DNA, 39380 bp, Homo sapiens
cagaataatatttttaaaattttattttctaagtttacctgaaattttaattttggtttcttatgtaataccagagttattaggaagttattagctaataacactattttcagtgatattttaagtatttgtcatagaaaaatttctatttttgaaaaatgtatatttaaaaatacattaaatttgtatatacatcaatcatatgtatcgatttatgttttttttgaattgcaaatgaaatttgtatttttgagttcctggaataaaataaacttgaatggattgtaatatattattcatgctgtaattcaatgtatttgaattctttaagaatgttacatttatagttaacagatattgacctataaattttctttcctataatgatgctgtgagacaatctaagaagaattaaaatttaaattcatgtattcctcctttttcctctgttctctaactgtaatatattttaattacagatggaggaacagatagatgttagataaataggtatataatatatagatcatccaaaattcttattcttatggttttatgtagtcagtatttacctctatttttctgcatgtttatccttccaatttagttcattacttcctgcacctttgatgtcatatacataaacaggaaataacacatggtggccaggatgtagagagagccacaggacttgtgaataaaatccacaggcaaggatgtggcgattcgttttgcaatattggagggaatgccaaaccctatgtttgctgtggaaaagagtatgttagttcgtcaaaacatcaaaatggtattgccatatgattcagcagctccacatctcaggatagcaaagtgactgaaagcaaagtcttgaaaaaatattttcacatccatgtttgcagcagcgttattggcaatagctaaaacgtagaagcaattgaagtgtccaacaacagatgaatggataagcacaatatgatatatacatacaatggaatattattcagccttaaacatgagggaaatattctgacgtatgttgcaacttggaagaaacttgaggatattatgccaagtgaaataagttagtcagtgaaggacaaatacagtataattccatttgtattaaagtggacagaatcatagagatggtacaatgatggttgccagaagctggggggaggaagaaatggagaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcatgtgtttatgcatagctttctatttttatcttttctctttgtattccaaattaaaaaaaagatgttttaattccaaattaaaaaggtgtttatattccaaattaaaaaaatccaaagttacagtcaactacacaaaaaaagcttagtctcattaatcattatgaaaatgcaaatggtaactgaaagaagataaaactacaattcaaagagaaagcctaaaatttcaaccccccaaaaagtctgagttttggagatctgggatggaatagggttcctaacctgacaacaatgaaacaaccaaactaacttcaaagtcatgactttatttttatagcaacgaggttgccaagaactgagtcaaaatgtgagggaaaacaagcacttgcaaggagaaagaggacagatgcacgtacataggatagatgcaaatagacaccactatgacaagtaaagctggaataatcaataaattcctaaagacaaagtggggctggtcagattgggagaccgctgacagctgcagaaattgggaaagatccatcatcttgaaaactttttccccacaaacccactgtgatctgtcaagcaattggtaaggaatccaagagagtctgtatatgacacagatcagggagagcagaacacttgggaggtgaccaggtcttgggagccgagcccttatgaatgggattagtgcctttataaaagaagctcaatggagttcttgtgtgccttccactatgtgaggacatagaaagaaggcaccatctatgaaccatgaaattggctctcatcaacactgaatttctgagcatcttgacctgagatcttacagcctcaagaagtgtgaaaaaagaaatatctgttgttttttagtcacccggtttatgttattttgttataagagtccaaatagaccaagatattccacttaatatgtaggggaaggcaacaaaaactgccacacttagaatactcctgatgctgggagtatgaaaacaggaaaaacaaaacaaaactgctcttgaaggtgaaggaggaatatcactgagctcaccaacacaaccaggaaaagaacagaagtgtgagaaggctacattcctgagaccctgagaaaaagtacctgcgtaagactgagatgaaattacataccctagttatgattgaaatcccaaaaagaaaagaggaaaaaataatggagcaaaagaaatatttttcaaaataactgcccaaaatattctaaaataagttacagaaaatcaaacttcaaatataggaaactcagagaatgtcaaatagaacaaaaagaaataagaattccatcttgaaaaatctttaaaaaatcaactctaaattttatatcttgctccaaatatatagagatataaataggttatcatcaagatgtggagaaagccatatcatggaaacactaaaataaagctgtggaaggactacattgatattagacacaacagagttcggaacaagaaatagtatcagagatgagagataatagataatagaataatcaattctcaagaagatgtaaacatcctactaattagggtatgcagctaacaacagaacctccaaatacatgaggtaaaacatgaaagaaataaaaggtgaactagaaaaatccaaaattatatttgcagacttcatctcttttgtcttagtaatggaaagactaggcacaaactcagtaatcatgtggaagttaagaacaacaatatcaccaacaagacatccaatcttcaatggcagatactctttcctttcaagtgaaaaaaaaaaaagtatggcatattctctaacaaacccagaatttttaatatttgcgttcttccttccttctttccatcttcctttctcttctcttcccttcccttgccttcttccttcctttcttcttttcctcttccttttcttttcttttttcttttcctttctttcttttctttcttttttctccttccttccttctttccttctctccctctttcctcttattcttccttccttcctccctcccttcctttctccctcccttttcttccttttctcataatctttctttctttctcacgttttctttccttttttctcccttcctcccgccctccttttcttccttcctccctcccttcctttcctctttttccttccttccttcgcctctttattttctttgtttctttgccttcctcccttttaccattctctcttcctcctttccttcctcccttcctcctttcttcctttctctgtttctgtttctttctctttctttccttctttctttcttgtgttcatgctttcttttttctcccttcctgcctttcttccttcctccctccctcccttccttccctcatttcctccttcttttctttcttctttctttctttatttccttccttccttctttttctttctttgttttcttttctttctttctctttactacaattcatattattttaaaaaaaattaagagagggagacagaaaaataaagaacgctttaatctgcaggtaaattgattatgtcttctgtaggcaaaagaatgtcctccccaaaattttcatgtcctaattcccagagtctaacatacaaatatgttaggttgcacggcagtgtgaaattagatttcaagtgaaattaaggttgcggaaaactgatagagagattgtcttaaatgggtgggatcaatgaaatcacaaacttccttataagtgaaagaagaaggcaaaagaaaggcaaccttggaggtggtggcatgagaaattactcaacatcactgaattttaagatacaagaatgaggacccagcatggtggctcacgcctaatcccagtactttgggaggctggggtgggtttatcacgaggtcaggagatcgagaccatcctggctaacatggtgaaaccccatccctactaaaaatacaaaaaattaactgggcatggtggcaagtgcctgtagtccaagctactcaggaagctgaggcagaagaatcacttgaagccgggaggcagaggttgcagtgagctgagattgtgccactgcactccagcctgggtgacagaaggagacttcatcacaaaaaaaaaaaaaaaaaagaaaaataggatataagaatgagttcatgttccaaggaataaaggtggcctctggatgccggaaaaaatcaagtaatagattctgctacatagccctcagaaagactgcagccctgtccaaaacttgatgttatccctgtgagtttcatttaaggcttctgaactacagaactgtaggattaacggtcactgtattgtaagatatgaagtttgtggtaattggttacagcagcaagaggaagtttatattgtaattgtatcatgaaaatgggaaccataatttacaactgcttttaatacttcacttggatgtttaaaatcatgtacatggaaatgatctctatgtgcatgagggatgatagcaaattgatgccaaaataatgcaaacgcaaatcttacactcatttctatgtaggtttcatttaatctttgaaattaaaatgaaattaaaagattgtgatcttttgatgaaattagactaaaatgaacaataacaaaataagaacttacttatattctttatatggtcaataaagaagtgatggtggaaaaaaacaagatcaaatgaaggtgatgatttaggaagttggaaagatagttgaaactacaaaatggtatataaccagtgaacacttagacacactgattgatgaacttcagcttttggcttgctgagagcataaaatgagagcagctgaggtttgcaaatttgtaatctccttgtggaaaaacaggggaaaacacatctcagcctaataagatttatctactaaagagtctagacttgatccatttgtccttgtaattcaaaagctaattcaaatactgatttgatgtattgtgtgaacaaccattgctgattatcatcgcatacctggcattctcttttatctgatatctaaaatatttggtaattcctggactttctcttttcaaacccagtatggtttaatttgagtcttagaacagtagtctttgagaaattcttccctctactgcatctgtgaatgggcatagcatagttacatacatactgtcactccatagaacatttgttaaattaaagccaaagtttaaagcaagagctttaacttactggttttactaatgtattcctccccaatagccacaacaatatttatactctcacaccttttagcataaagcttggtgttgtctatttttcaggtgctgtcatctatatgatctcagtattttaaaaaccagcttccagcccatatggtggttcatgcttgtaataccagcagttgagggggctgaaatgagaggattccttgagcccaggagttcaaaagcaacctgggcaacatagcaagacccagtctctatcaaaggttaaaaaaaaaagtgggcatggtgatgtgcacctgttatcctagctatttgggaggccaaggtggaaggattgcttgagcttgggaggctgaggctgcagtgatcagtgattgcaccactgcaatccagcctgggcaacaaagcaagaccctatctcaaaaaatatatataatgaaaatgaaaatcagctctcattgatttctatgtaaatatgcacaggtgatgtccatatagacataaataataatatttctgacaatgggtccatatgatcttcaaaatgtaaaatgcctatctgtgtaatttactggttagtctcattaatgaatatagattcaattctactttcttgttctagataaattatataatctagcttttcatttcacttatttactgataacaacaggaggaatgaaaagatatctattttggaaaattactctggtaggagtaaacatgaaacaatgatagaattgcacggaaaactagaaaaaagtatggtcttctgatattctatcacatcacatactaaagtcctcataaaactcagatattttatctaaaaatgttattttcatcataggaatgatcaaagcatgatactacaattgtattaaaatgtgcttgtatcacaagcacaggtgctaaaaaggaggggaaaacatcattactgatattttcaacgtatgttttactttccttcaacatgaacctcaacttgatatgatgcagattgaaggaaatcacccataattccatatgaagaaggcctgtgatattttatgggaaaataaatagagaaaatgctaacagaagccctattaagcatgaagctttatggagcaaacacaaatccagtggtgaaagatacacactagagttctgtttgttgtcctggaacaatacggtttagaggtgactggcgggtgaggagaacatatgcgagttcaccaaagagaaaagctgaatgaggcaatgcctcttcctgaccatatctcttactcagataactatataatttattgtccagtaaagggtatatttaaaaatcatattaaaagtcatgcagtgaagttgtccagggaaatcaagacttaacagtctcattctgacaaaaatgaacagggggtttccctcaagatagactaggacatgaccccacactggcagatagtagtaccagaaaagaacccatggaaaatttttaccttatgcaggctaaagtgaaagccagacataaaattctatctaaaataaatccacaatcgtagaaaatatgtggtgtacaggcatagaatgtctttactggatcattgaaatagtaagataaattcaactttttacattgttttcttttcctccagttagggcttgaggtttgtctctggagagtgactgtcaattggagccctgtctttctggggttctggtcagggggttgtggatgcttaacatgtgcctttcacaggacatttccttaccccagcagtggccaggtgtgcattccacgaccaggcctccctctcacagaacatctgttgagactaggagattcctggtgactgttgcctgacttgtgtcctgtgtatttctgacaagagcccctctcagagaccctggccaggaggagagttaggttccagtgtaggtcagctcagacccatggaggccacagaaccaaacatgggaaatcacagaagtaggtttattactcacagatccagagagaagagggtagctgagaagagggtttagctgtgtcctcagccaaatctcatcttaaattcccacatgttgtgggagggaacaggtgggaggtaattgaatcatgggggcaggtctttcccatgctgttcttctgatagtgaataagtctcacaagatctaatggttttataaaggggagtttccctgcacaagctctcgtcttgtctgctgccatgtgagacgtgcctttcaccttgtgccatgattgtgaggcctacccagccatgtggagctgtgcatctattaaacctctttcttctggaaattacccagtcttggacatgtctttactggtggtgtgaaaatggactaatacagtagcacacctcatagggctgaacaaaatggggaagatgagtggggagcaggagagagaaaagtggtctgtgggactccagcctttattgggtccagatcattacccatataagttttccacggggcactagtcggtggggtgagtgccagcaggcacatttcttgactcccgctgcaactgagcaggtcactctggcgtgtgggggctgtccatgtgcgctgtgaggtctgtggggtgagtcaggtaggttgtatccaacggttccatagctggtagtcaccaggaggaggcaactgtgtagggtcgatatctgggcaagccacactgaggaactgtgagggttagaactggaaattgtcaagagaatctgaacccagctaccatatgagagagttcaacttatgttcaatgtgaatgccatggcaatattaaaaagtaagaattcactccatacgtgcttgaggtaaataggagaaacctagaatttatgtaaacagtgagaagattggatgcgttttccatcacatattttaatactagcagcatatgatatatgtcaatccatcaggcattcagaaatacatgcttatgaaaaatttttgcaccatcagacaaaagacaagggtagaagacatttgtaaccctataaacactagtaaattaaaaacagaaggacctttatgtcctaacatatctgtgttgtgaaaggctgccctgtgaaatacgagatttcttaaacatattttaaaaatcataggtgtcaatattttttagaaatcaatttaaattttctcttgctattttacaatgcctatttatttatttagtggctctgctgattttgacgtatatcctaaactttatattttctttaaaggatgttttatacaactttatgtaaaatgtttcagtatcttcacattctctccctgtccttttgttttgctcttatatggtggtcttgagtcttttctctggcttttcaaacctagtaagactaagacactaaagtaactttgcccgtggtttggtaatgccttctaaagcacatcctaagctctcgtgcataggggggcctcctttgagctctgtgcttttgagatcccatatacctaaattccagtactccaaatcagtactgctcagttttagttactaagtttaaaaatgtaatttaatagcaagttagtttagtgcactcttgcttctttcttgactgcttgtatacatgtatattcctttaaatgaatcttggaacttatttaaaaattttaaattatactaatgaaactgtatattgttgtgaattcataagtgaatgtggaaagaatttgtctttatgatagtaaatcctttttatccaagaatcatatgtgtctttatatttattccagtctatatttatatcactgagtaaatatatagaaatgtagatacatacagctgtagttctagatacaaatatagatataacatgttaaatctatatctatcccatataacatatatacatgttatatttgtgtgtgtatatatatatgtttatattattaaagagctcccttaaaatttttcttttatttcctatataattttaggtcgagcttgaattttccttgtataaacaagcaaatatttatactagttttaatactgatgtttaggcattctatcttattttaacattgaatattttcacaattattataaatattatctaatattaataatgtacctgttaaaaatatttaaaattttacctttgaattattttattgttgaattaaaattcctttaatatgatagtaaatttctatttcatgctttctctttgcatatgcaaattaatctatccacttctctatctctatgtagtaacatatgaaaatcaggcctctcttcttctaatggacatacacatgtttgcatatagaatatcagactctttatagcatttaaaatctttaaagacatgaatattgccttttaacaaatatattttagcatgtactgagaatcccctatttatttttaatttgggctaatcaatatgattattaatattattggattaccaaatttggaaacacactttcatccccaaggtggatatttgttttttttttttttttgccaatttcttctcttactgtttcaaacattgttggatattatttttattttatttggcattttagtatcaacatttctaattgatgtactctacatattttttcttcaatatctggtgggttttataattactgctatgttggatttgtagtagccattgacaaaaattattcctgtatgttttatagctgtatgaaggaaactaatatattttacccctaaatatatttccttgatatatttcaaaatggctattgagaagggctggaaatgcaaccttagctgcaaagctgtcttggggatatttgcatcagtagagaatctgccttgatgcagccaggctttctctgaggtctgccccttgtctggatctaggaaaggttaactgagagtctgaggtccccaaaaggtctgaaagaaacattttctgtctattctctctgaggactgctcccagtgaggttccacctatgtaataagtccactgttgctagccagcgtcattttctcacataacctttttttttttttccctgtgatccaagaccccattctttctgttaacttcatgtggtaaataagcttctgcacgcatcgtgtgtctgggtcttcgttctaagggctccagtgtacacacattgcagaaacctgtatgccttttctatttatctgcctcctattagtgattttcagggaaacttcagaaggcaaaagggacattctcctttagcccattctcatacaaaatctcccaacatttaactgattcttaatagcttaaaatcactttgaaaaatccatatatttataaccttttcttccctctatgatttctggtcagcttgggttttgtttttcattccatttattcatcctcgaaaagatctattttacgtctatttattctcatttatggacattgagaaaagaaaataactttcatgtgagaaatgcaagtccttttaaataatcaggcccagagagatattcaaatgagacagcagttctgtcctgctcctctttgagctgtgtgttcatctaggctgcttgctgttgccactgtagctataaattaaccaataacgccacaccagacactataatccacacccaataatagtgtaacagtgtatagccagtcactaataaatgttatttccataagccaatgagaatttgtgacaaacctctttgcatcatcccacttctggacccttttttgcctttaagaaactgcttgttgcaaagctccaaagggagttcatatccaaggatacttgggtctgtttcttccaggcagctgtcctcgttttggctcaagtaaactctttgaattaccttttgtgcttcagccccttccacttagattaacaacatggatttgtgtcaccatgtacggcaattaaaatgtttacacttttcccctcgagggcactgatgtgttttcctgagcacttggaatagctacgtagtgtttgctgtctagattatggtttctcaaccttggtgctacttacctttaggaccagaggattctttgttgtgggaggctgccctagcaatgctaggtgtttcgtttgacctctaaatttcacacctccaccagtcttgacatccccacaataaccctagacattgacaaatgtctcctggggaaaactctccaccagttgacaggcaaagttctggaaatattggaattgtcaattgagattttatgttatccaaaacaaatatttttctttgtttttaaacatctacttccatctacttatctacttatttttacttttatttgtaacttaattccatcaaggagagagagtgcattttctgttatgctaaatttttgaagaatgtattgattttttatgacctgatatatggatgatatgtagatattacatgtttgtattatcaaatttcagggcgataataaaataaatacttataatatttatatagtcactgtatattagttattttctttcttcactacaggagtttttcaacctataggctatttttcaattctaggttatccagtagattttgaaatgttatgattaaatatctacttctgaagcattcatctttgcaaatgaaacaatcccaagctcttataatgcacatcatataaagggcagattagtcaatatatggttcagaaataattatgtaatatttataagaaaattaaaaatttagatccttaactcagataacaataatccaaattaaaatttgatttcattacataatgtaaaatgacaccagaatactagtaaaaatgtagataagtttatataatcttttttagctgtaggactttattagcataaattcaaatacaggaaccaaagtaagattgagacctatagtcaaaggttaaaatgtacacattataggggcatgattaaactaatttaaagcataataacatggagaaatattgcaaaacatacattttactgaattgttaatatctaatcattatgtgagaacaaaattaaagagtagctacacacgcacacacccacacacaaatgcaatattgtcaaataaacgatgttcagctacactagaaatcacaactgtgttttctccagagaaaagattaaaaatcacaataatatttattgtacatatggaggtaaagatactcaaaatattaccctaaaatacatttttttttgagatggagttttgcttttattgcccaggctagagtgcaatggcacaatcttggctcactgaaacctcagcctcccagggtcaagtaattctcctagctcagcctcccaagtagctgagattacaggcatgcaccaccacactctgctaatattttgtatttagtagagacggggtttcacgatgttggtcaggctggtctccaactcctgacttcaggtgatctacccacttcagcctcccaaagtgctgggattacaggcgtgtgcctgggcagctttttgacatatttcaagatggctactcggaagactggagatagcttcttctacaagaatagctgaaaagctgtgtttgttggggagatttgcattcgtagagaaaatctgcattgatatagacaggctttccctgagatactcacatgtctgggtttaggaaagattaactgagcctggcacgtttacatttctaaaaaccatttcctatctatactttccaagagaagggctgctccctgtgaggtttcatccatgtaacaagacaacctctgctgccaggctcctctttcttccttgtcgtcacctgtcttccgcaaagcctgatttaccaacctacagctctgtgttttctgtaacctcaagacagcataggcgagttgactaccttgcctttcctggagtttttatatatatagtatatatttgtatatctatttataatatacaaatatttgtatagatatatttatatatattatgtaaactccaagtgcatacttgtgtacatatctgtaaacctttctttcctgttaatttgtacattatcagtttgttttatagactcaaataattaaagcttcaagggaaaaagttaaactttcctatagagaaaagacaaatatataggtgacaaataatatttagagtgtaagatgctttttaaaggtatatttgcaatttgtgtcaaaacatttaaatatacatttgttattttaactataaaatttcaaataatttaagccaaatacatagtatatgcagaaaatttagcaatatatctatgtagcaccttactgtgcattactgtaaccagccgtctaatataaagaattaattaaggtagcagctacttttcaaatagcgcatttttttcacagacctattaaataagacaaataacatttaaactttatttttaaatttgcagaatagtagttttcagcagatggtttattttagcaaattccatcttcacattgtgctatgcttttatgagttccagctgttaacggataatattttagtgctgaaactatcatgtgtgatataattgctcattatgtgccttaaaacacaagcaatataattattttcaacttggagcaaattaaaatcttatcagcaatttaaaaactctagagtcgtcttcttctggttaattattttaaacttgtatttttctctttatgtttttagtgagttgtcttatcaaggagaagaactcaagctgattattctttttttttctcttccatccacctcgcaggtgtgttaataatttcatttctgagaaaatgttctttcatatccatcttacaagatgagagaccttttaacgtctttcattccgatgtgataccagtaatggaaaatattccagcttcacgaatatggtgatacaaatagttatccatctaacctctgtcagtgccaaatgtttactttactcagtgaattactcagttgactggtaatttcttctgaaatcactaatgagagggtcagaggtctggctgtggtctgtacctcatgtgactcccagtgcagacaattgtttctatggagcacagacagttgaaaggattgacttcctgcctagaatagtttctgctgtgctccttatctttctttcttttttttgtttttattatactttaagttttagcgtacatgtgcacaatgtgcaggttagttacatatgtatacatgtgccatgctggtgcactgcacccactaactcgtcatctagcattaggcatatctcccgatgctatccctctccccttcccccaccccacaacagtccccagagtgtgatattccccgtcctgtgtccatgtgatctcattgttcaattctcacctatgagtgagaatatgcggtgtttggttttttgttcttgcgatagtttactgagaatgatgatttccaatttcatccatgtccctacaaaggacatgaactcatcatttttgatggctgcatagtattccatggtgtatatgtgccacattttcttaatccagtctatcattgttggacatttgggttggttccaagtctttgctattgtgaataatgccgcaataaacatacgtgtgcatgtgtctttgtagcagcatgatttatagtcctttgggtatatacccagtaatgggatggctgggtcaaatgctatttccagttctagatccctgaggaatcgccacactgacatccacaatggttgaactagtttacagtcccaccaacagtgtaaaagtgttcctatttctccacatcctctccagcatctgttgtttcctgacattttaatgattgccattctaactggtgtgagatggtatctcattgtggttttgatttgcatttctctgatggccagtgatggtgagcattttttcatgtgttttttggctgcataactgtcttcttttgagaagtgtctgttcatgtccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctccttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagttgtaaggaagggatccagtttcagctttctacatatggctagccagttttcccagcaccatttattaaatagggaatcctttccccatttcttgtttttctcaggtttgtcaaagatcagatagttgtagatatgtggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggacattttcacgatattgattcttcctacccatgagcatggaatgtttatgccaggcagagacacaacaaaaaaagggaattttagaccaatatccttgatgaacattgatgcaaaaatcctcaataaaatactggcaaaacgaatccagcagcacatcaaaaagcttatctatcatgatcaagtgggcttcatccctgggatgcaaggccggttcaatatacgcaaatcaataaatgtagtccagcatataaacagagtcaaagacaaaaaacacatgattatctcaatagatgcagaaaaagcctttgacaaaattcaacaacccttcatgctaaaaactctcaataaattcggtattgatgggacgtatttcaaaataataagagctatctatgacaaacccacagccaatatcatactgaatgggcaaaaactggaagcattccctttgaaaactggcacaagacagggatgccctctctcacccctcctattcaacatagtgttagaagttctggccagggcaattaggcaggagaaggaaataaagtgtattcaattaggaaaagagtaagtcaaattgtccctgtttgcagacgacatgattgtatatctagaaaaccccattgtctcagcccaaaatctccttaagctgataaggaacttcagcaaagtctcaggatacaaaatcaatgtgcaaaaatcacaagcattcttatacaccaacaacagacaaacagagaggcacatcatgagtgaactcccattcacaattgcttcaaagagaataaaatacctaggaatccagcttacaagggatgtgaaggacctcttcaaggagaactacaaaccactgctcaaggaaataaaagaggatacaaacaaatggaagaacgttccatgttccttatctttcttgtggagatttcagataatctgaattgcttttctatcttaagaaaaaatgcaacaattctcccacctgagaggaatgtaaactgtagtaagttagcagaaccaatccgtaaaatttttacattgtttgttgcaaaatgcagcgctggggtctccttcactaaccttttctatccctcattgctctttctttgactgcaataggttacctctgggcaaatctgtattcccgagaaagagtgcccttttggtgagctataagcacactcaatggtgggctgaaatactagcttttatctatggcgaaatggaatcatatcagtgatttttttaaaaaggaaatttaactcttgctatggtttgaatgcttgccccttccaatctcatgttaaaatttgatccccaatattgcaggtggggcttactgggaggtgtttggtcatggggttggaccttcatgaatggataataccctcccttaggaatctaaaggtatcctccctcctcggtgccctcaggaatgggtgtaccattctttattcacttataattcctccacccatcctttttgagatattaattacatgtatgttacactgctgcatattgtctgacgtatcagtgagtttctggctttcttattttagtttaacctttgtcctttagtttgtaaagcttctatttttttctataaattttctgatgttagggtaaaatccattacttattctatctcatggaatttttatttcaaatatttattcttcatctatacatgtcacatttttcattttataacttctatttttctcctatgttcaattttcatttaagtaccttgacatatatatgtattcatctatatgtatttataaaatatatttactttaaggaccttgaaatttccttcttctctgtcatttataaatgacttatttttatcctattaatatatatcttaattatatatatcttacggcttctttgcatgtcagagtttttttttgggtattttggtgttatgctattgaatatctagattttattggctacctttgaacaatgttgtggcagacagttcagtaacttcaggatgagtatttgtctgttgttgttttaaatcttctctttaaactttgtcgagttagtctagagccatctgtaatttggagctaaatgagcactgtctctagggcatgaacctccagtggtctttactgaatatcctggaggtacagaggggattcccttctctggctggtcagagctaacgtgtcttcctgtcatgtgaagccagggaagtgttcttcttccaactccctggtagagtcctttgctgagctccttagaatttcatcctatgtacatttggcttagggacttgggagaatccttaggctgaatcttggttcctttttctgtaaacgttctcttctattacacattccagctgcttaaccttttttgatttttatctggttcctcagtgcaatgacaatgtctgctctctctgggattcctctctactgctgtcacggagaatctgggaataaagcaggactcattctggctccttctcttctcttgcagagcacagtcctacgctgcctgatgttcagtacttcaaaaaaatgtttcatatattttctccagtttactattctttaaaagagtaactccagtcccagttacagcatcatgttctgtaactctactccttgttgcttcattctgccattgtctggtatgatcgcccctttcccttctgtaatcagaccaagagcataatataacactagttataactgcacagcttgcctccgttgtttaaaaaaatcactgagacttaactgtgtacaacttttaaaatttgaatataagtacaactaaagctatattttggttaatatttgcattgcatgcttttccattatttactttcaacatatgtgaaatatgaatatagctccctctccctctccctcttgtctccccacggtctccctctccctctccctctccccaaggtctccctctccctctccctctccctctccccacgttctccctctgatgctgagccaaagctggactgtactgctgccatttcggctcactgcaacctccctgcctgattctcctgcctcagcctgccgagtgcctgcgattgcaggcgtgcgccgccactcctgactggttttcgtatttttttggtggagacggggtttcgctgtgttggccgggctggtctccagctcctaaccgcgagtgatctgccagcctcagcctcccgaggtgccgggattgcagacggagtctcgttcactcagtgctcaatggtgcccaggctggagtgcagtggcgtgatctcagctcgctacaacctccacctcccagccccctgccttggcctccaaaagtgccaagattgcagcctctgcccggctgccaccccgtctgggaagtgaggagtgtctctgcctggccgcccatcgtctgggatgtgaggagaccctctgcctggctggccagtctggaaagtgaggagcgtctctgcccggctgccatcccttctaggaagtgaggagcacctcttcccggccaccatcccatctaggaagtgaggagcttctgtgcccggccgcccatcgtctgagatgtggggagcgcctctgccccgccgcccggtctgggaggtgaggagcgtctctgcccagctgtcccatctgagaattgaggagaccctccgcccggcagccgccccgtctgggaagtgaggagcatctccacccggcagccaccccgtccaggagggaggtgggggtcagcccctgcccggccagctgccccatccgggagggaggtggggggtcagccccccgcccggccagccaccctgtccgggaggtgaggggcacctctgcccagccgcccctactgggaagtgaggagcccctctgcccggccaccaccccgtctgggaggtgtacccaacagctcattaagaacgggccatgatgacaatggcggttttgtggaatagaaaagggggaaaggtggggaaaagattgagaaatcggatggttgctgtgtctgtgtagaaagaagtaaacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatatgctttgttaaacagatgcttgaaggcagcatgctcgttaagagtcatcaccactccctaatctcaagtacccagggacacaaacactgcagaaggcctcagggtcctctgcctaggaaaaccagagacctttgttcacttgtttatctgctgaccttccctccactattgtcccatgaccctgccaaatccccctctgcgagaaacacccaagaatgatcaataaaaaagtatagcaatttataatgtttgatttatcattagcctattggcgtgtaataatactttgcatacttttaaaattctggggttggattaataataaaagagtagaaacattaaaaaaatatgaatataaattataaaaattttaagagagtccatttaaaaaatctggtctagttatgttttacctggtttaatacaacgtgcattcttgaattcagggtctaatataatggctacatttgtctatttgcaaaaaaaaacttgacaatattttaaaattaatttatccaactcgcaacttatatgcttctgccgttgtatggaagatacattttaaactttatgagatagcattctgttatacagttgatatctaattaaatttctctctatgtttatttctttcattaaaaaaattgttcttctaactgcaaactttcatcagggatcatggctcttctacctgaagaataatctttagtatttcttttcctgtgggtcttcttgggagaaattctttattgtatctttgcttttgatggatatgtccaccaagtagacagttctaggtcagcacatattttatttcaggacttgaaagatatcaatacctcacttgttggctttcgttgtttcatttgagaaatttgttatcagtcaactctttctctttgtagttaccccaatttttttatcaagtgctctttacatttttcttttacttttcagaaattgtcccattatgtttctagatgtgtcctctgtgtgtgttttcctttgctttcaaaagcctcctgaacctgtggtttaatattattggtcaattttgataaaacctctaacattgccacttaaaatgctgttcagacacgctgttttctccttcttagatttcaacgtgttagattattactctatccttcatattttttaaatgaccttactctacaatttcttttagttggttaatctgtattactgtatattttgtattttattctattttattttattattataccttaagttttaggatacatgtgcacaatgtgcaggtttgtatcataagtgttcatgtgccatgttggtgtgctgcacccattaactcgtcatttagcattaggtatatctcctaatgctatccctccccactccccccaccccacgacagtccccgaagtgtgatgttccccttcctgtgcccacgtgttctcattgttcaatacccacctatgaatgagaacatgcggtgtttggtttttggtccttgtgagagtttactgagaatgatgatttccagtttcatccatgtccctacatagggcacgaactcatcgttttttgtggctgcatagtactccatggtgtatatgtgccacattttcttaatccagtctatcattgttggacatttggggtggttccaagtctttgctattgtgaataatgccgcaataatcatacgtgtgcatgtgtctttatttcagcatgatttatagtcctttgtgtatatacccagtaatggaatggctgggtcacatggtatttccagttctagatacttgaggaatcgccacactgacatccacaatggttgaactagtttaccgtcccaacagtgtaaaagtgttcctatttctccacatcctctccagcacctgccgtttcctgactttttaatgatcgccattctaactggtgtgagatggtatctcattgtggttttcatttgcatttctctgatggccagtgatgatgagcattttttcatgtgttttttggctgcataaatgtcttcttttgagaagtgtctgttcgtgtcgttcacccactttttgatggggttgtttgtgttttacttgtaaatttgtttgagtttattgtagattctggttattagccctttgtcagatgagtaggttgcaaaaattttctcccattttgtaggttgcctgttcactctgatggtagttccttttgctgtgcagaagctctttaatttaattagatccgcttcgtcaattttggcttttgttcccattgcttttggtgttttagacatgaagtccttgcccatgcctatgtcctgaatggtattgcctaggttttcttctggggtttttatgattttaggtctaacatgtaagtctttgatccaagttgaattaatttttgtataaggtgtaaggaagggatccagtttcagctttctacatatggctagccagttttcccagcaacatttattaaatagggaatcctttccccattgcttgtttttgtcaggtttgtcaaagatcagacagttgtagttatgcggtgttatttctgagggctctgtcctgttccattgatctatgtctgtgttttggtaccagtaccatgctgttttggtgactgtagccttgtagtatagtttgaagtcaggtagtgtgatgcctccagctttgttcctttggcttaggattgacttggtgatgcgggctcttttttggttctatatgtactttaaagtcattttttccaattctgtgaagaaagtcattggtagcttgctggggatggcattgaatctctaaattaccttgggcagtttggccattttcacgatattgattcttccaacccaagagcatggaatgttcttccatttgtttgtatccttttatttcattgagcagtggtttgcagttccccttgaagatgtccttcatgtcccttgtaagttgggttcctaggtattttattctccttgaagctattgtgaatgggagttccctcatgattgggcactctgtttgtctgttgttggtgtacaagaatgcttgtgatttttgtacattgattttgtatcctgagactttgctgaagttgcttatcagcttaaggagattttgggctgagacaatggggttttctagatatataatcatgtcatctgcaaacggggacaatttgacttcctcttttcttaattgaataccctttgtttccttctcctgcctgattgccctggccagaagttccaacactatgttgaataggagtggtgagagcggacatccctgtcatgtgccagttttcaaaaggaatgcttccagtttttgcccattcagtatgatattggctgtgggtttgtcacagatagctcttattattttgagatacgtcccatcaatacctaatttattgagaatttttagcatgaagggctgttgaattttgtcaaaggccttttctgcatctattgagataatcatgtgttttttgtctttggttaggtttatatgctggattacgtttattgatttgcatacgttgaaccagtcttgcatcctagggatgaagcccacttgatcatggtggataagctttttgatgtgctgctggattcgttttgccagtattttattgaggatttttgcatcaatgttcatcaaggatattggtctaaaattctctttttttattgtgtctctgcccggctttggcatcaggatgatgctggcctcataaaattagttagagaggaatccctctttttctattgattggaatagtttcagaaggaatggtaccagttcctccttgtacctctggtagaaatctgctgtgaatccatctggtcctggactcttttttgttggtaagctattgattattgccacaatttcagagcctgttattggtctattcagagattcaacttcttcctggtttagtcttggaagagtgtatgtgtcgaggaatttatccatttcttctagattttctagtttatttgcgtagaggtgtttgtagttttctgtgatggtagactgtatttctgtgggatcggtggtgataaaccctttatcattttttgttgcgtctatttgattcttctctcttttcttcattagtcttgctagtggtctatcaattttgttgatcttttcaaaaaaccagctgctggattcatgaatgttttgaagggttttttgtgtctctatttccttcagttctgctctgattttagttatttcttgccttctgctagctttggaatgtgtttgctcttgcttttcaagttctttgaattgtgatgttagggtgttaattttgggtgggggatctttcctgctttccttgtgggcatttagtgctataaatttctctctacacactgctttgagtgtgtcccagtgattctggtatgttttgtctttgttctcattggtttcaaagaacatctttatttctgccttcattttgttgtgtacccagtggtcattccggagcaggttgtccattttccatgtagttgagcagttttgagtgagtttcttaatcctgagttctagtttgattgcactgtggtctcagagacagtttgttataatttctgttcttttacatttgctgaggagagctttacttccaactatgtgatcaagtttggaatgggtgtggtgtggtgctgaaaaaaatgtatattctgttgattttgggtggagagttctgtagatgtctattaggtgcgcttggtgcagagctgagttcaattcctgggtgtccttgctaactttctctctcgttgatctgtctaatgttgacagtggggtgttaaaatctcccattatgattgtgggggagtctaagtctctttgtaagtcactcaggacttgctttaggaatctgggtgctcctgtattgggtgcaaatatatttaggatagttagttcttctcattgaattgatccctttaccattatataaaggccttatttgtctcttttgatctttgttggtttaaagtcgattttatcagagactaggatggcaacccctgcctttttttgttttccatttgcttggtagatcttcttccatctctttattttgagtctatgtgtgtctctgcatgtgagatgggtttcctgattacagcaccttgatgggtcttgtctccttatccaatttgccagtctgtgtcttttaattggagcatttagtccatttacatttaaggttaatattgttatgtgtgaatttgatcctgtcattatgatgttagctggttattttgctcgttagttgatgcagtttcttcctagtctcgacggtctttacaatttggcatgtttttgcagtggctggtaccagttgttcctttccatgtttagtgcttccttcaggagctcttttagggcaggcctggtggtgataaaatctctcagcatttgcttgtctgtaaaggattttatttctccttcacttatgaagcttagtttggctggatatgaaattctgggttgaaaattcttttctttaagaatgttgaatattggcccccactctcttctggcttgaagagtttctgccaagagatcagctcttagtatgatgggcttccctttgtgggtaacccgacctttctctctggctgcccttaacattttttccttcatttcaacttttgtgaatttgacaattatttgtcttggagtttctcttcttgaggagtatctttgctgcattctctgtgtttcctgaatctgaatgttggcctgccttgctagattggggaagtcctcctggataatatcttgaagagtgttttccaacttagttccattctccccgtcactttcaggtacaccaatcagacgtacgtttggtcttttcacatagtcccttatttcttggaggctttgttctttttattgttttttctctaaacttcccttctcccttcatttcattcatttcatcttccatcactgataccctttcttccagttgattacatcggctcctgaggcttctgccttcttcacgtagttctcgaaacttggctttcagctccatcagatcatttaagcatttttctgcattggttactccagttatacattcgtctaattgtttttcaaagttttaaactttttgctattggtttgaattccctcctgtagctctcagtagtttgatcatctgaagcctccttctctgaaatcgtcaaagttattctctgtccagttttgttccattgctggtgaggaactgcattcctttggagaggagaggcactctgctttttagagtttccagtttttctgctctgttttctccccatctttgtggttttatcaacttttggtctttgatgatggtgatgtacagatgggattttggtgtgggtgtcctttctgtttgttagttttccttctaacagagaggaccctcagctgcaggtctgttggagtttgctagaggtccacgctggaccctgttttcctgggtatcagcagcagtggctgcagaacagcggattttcgtgaaccacaaattcagctgtctgatcattcctctggaagtttggtctcagaggactacccggccgagtgaggtgtcagtctgtccctacaggggggtgcctcccagttaggctgctcggtgttcagtgacccactttaggaggcagtctgcccagtctcagatctctagttgcgtgctggcagaaccactactctcttcaaagctgacagggacatttaagtctgcagaggttactgctgactttttgtgtgtctgtgccctgcccccagaggtggagcctacagaggcaggcagacctcctggagctgttgtgggctccacccagttccagctgcctggctgctttgtttacctaagaaagcctgggcaatggcgggccccacttccccagcctcactgctgccttgcagtttgatctcagagtgccatgctagcaatcagcaagactccattggcataagactctctgagccaggtgtgggacacaatctcctggtgtgccgttttccaagcctgttggaaaagtgcagtattagggtgagagtgacccgattttccaggtgccgtctgtcacccctttctttgactaggaaagggaactccctgaccccttgtgcttcctgagtgaggcaatgcctcgtgctgcttcagcttccacacggtgagctgcacctactgtcctgcacccactgtttgtcactcccttagtgagatgaacccagtacctcagatggaaatgcagaaatcacccatcttctgcgttgctcacgctgggagctttagaccggagctgttcctattcggccatcttggctccacccctcatttcattatttcatcatttcatcatttcacttcatttcatcatttcatttcatcatttcatgccatttcttcatttcatcatttcatcatttcatttcatttcaccatttcacctcatcatttcatttcagcatttcatttcatttcttcatttcattccaccatttcatttcattatttcatcatttcatcattccatttcatcatttcatttaatctcatcatttcatttcatcatttcatttcatttcagcgtttcatcatttcaccatttcatttcatctcatcatttcatttcatcattttatcatttcatttcatttcatttcatcatttcatcatttcgtttcatcatttcatttcatttcatgtcatcatttcatttcatttcagtgatacatgtatttaagtgttaatgtgatgcccaggagacacactatttccctttgtaaaacacctccttcaacaaaagtcaacctctcatggctggctaagtctacagggataccagcctctcttcaactacccaatttgattcagaacctcaaacagcaccgcagtttcataaaaacctaaaacatatacacaacacttggttgtaagtgagccaacagtttcttgtctctttctctgctcaaggcttaaggccatgtctccccaactacgttcagtggaagaaaagatcccctggacaaataagtttgagaactgttgttgcaggacttctgagaacctttaaaacacaaatcctcatctgcagggatcttcaggagggagatggctgatgcagcacaactttctttcacaggagcatcttgcagaatacagtatgagatacagaaaggctgcattgagtctttttaagggcctgggccttggtggaggtggggtaggagctctccagatagcatctaatgagtaggaacattcaggttgctttttatttccttactggcaaaactgtgtgtgcatcatgaatgaagccggtctcccttatccatatcaaaactaaacccaaattaattggctgaattgggactcaacacctccaggagccatgcggaagaaagccccaccacactttacagtagcttacctaatcatatttgatgaaagcaaaacgcttatgaccagtgtgctgctaatacaagtcaacagataatgctgtaggaaaaattatttttcccaatcatagcttccatagcccacattttgcattacactttccccccttttttaaaattttaaacacaggtccttttctctccttttttaaaattttaatttaattatacaagacagactctcagtatgttgcccaggctggtcttcaattcctgagatcaagcgatacatccgtctccgccttccaaagtgctgagattacagccctgagacactgtgcccggccttaaacacaaatcttaattcattcttacaattatcctgaggttagaaaaatggaaggggaagaaaaatagcaagcaggtaggctgacttcggcttcattatttggaaggacagtttgctcggttaaaacacactactgcccacaaaggccaagataacagaaaaatacagacatataaatagattttatatgtgacagcagtttgaatggagactttttcaatgcaaatgacaaacagctgtgcttgggaataaatgacaacgaattttttttatcttaacagctgtcctgagagcatgtctctacatctctacctgcattctggagtcagggagaaagccaaaacggatgacaagacactagatcagccgtgtccaaccctttgactacaaggacttttccacctatctgtggttgtgggtatcatgaaaattatgcacaaacttttttttttaagctcatcagctatcgttagcagtagtgtattttatgtgtggcccaggagcattcttcttccaatgtggccctgagaagccaaaagactggacacctgtgcactagatcaaaaggctactccttctggaagcaattgtaaagaatttctgacattatcttgacatgaaaaccaatggatagtgggacagaatgaaaaatcttcaagaatttttcttgttggtttttttttttttgagtcaaggtgttgctctgtggcccaggctggagtacactggcgagatcacagctcagtgcaggctcaagtgctcctcccgcctcagccacagtagtagctaggactacagatgcgcacaaccactcctggctaatattttattttttgtagagatagggtctcactatattgaccaggttggtctcaaactccttgactcaagggatccaggacaggataacaggcatgagccaccacacctggctatgcgcatgaactttgaagacaaatacaaggctccacaaaagttaaggttttcccacctaatttccagggaatcttttggtgcaaggatgagaaacccttaaaagtacgcagacaactccaaagattcaagagagttcattcgggctgagccagcccactgggcagactgaccttcaagcaaggcccacccatgacatacaccagatggctctccaagaatctctccacttctcagggtccctaaagtactggacagagctaggaaagcaaacccatttgcttattgctgcacgaaaccccttgaggtcaagaccccacaatcagacaagaatggagtggctcaccctcagtcaacaggccagactcaaggtggtataatgtcttaaccaagggtgtgggactccaggtctgaatctcaactcagttctcctttgataaccacaatttgttaattttccttaacaggggttcctgacaagtcatttctccctcaggccttcggtttcctcacctacaagatgagaaggctgcaccagatggaaattcggggtgtaaggggacgtccgcgcacagcccaccccacccacgggcccctcgagcctccatcaaagttcccaacacgcacccaccccacaaatcctgcccaaggtgagggctggtcccaggtcctccggctgctgcatcagcgagtgcaggagggaggagaagcctccaagggagagacgcgggctcaagcatgcaactcggccgggagtgaactggggccccgagggagatgtccagtctggtgctggagcccaaccctggtccccgacccccttatctccactgtccgtatctcctgctgggtgaggtccttggacacagtgcacttggtgcgcagcccgcgcaggctgccaatggagatgccgatgagcttctggagctgcctgcagggctgcagcgcccggctggccgcggcccctgtgcctccctccgcgatagccgcgtcacccccgccaccgccctccttcttctctcccatcggggcctagcgcagcgcccctctatgcaggctgcagtggcccaggagcggagcctggggcgcgggtgtctaggcaaggaacccccgaaccaggagagctagatcaggagtgaccctcggagctgccttagccaggacgccagtagatctggaagccgagtctgacgatcccgccctcagacccgcggcggtgggggcaaaaacccgcgacggcggggtgaaaaagcctcagcggtaaaaacctgccgcagcggcagtaaaaagccgcatgggcaagaagccatggcggcggggaaaaagccacggtgatggcaaaaagccgcggcggcgggggcaaaaagccgcaaaaagccgcggcggcgggcgcaaaaagccgcaatggtgggggcaaaaagccggggcggtggcggaaaaagccggggcgatgggggcaaaaagccgtggcggcgggggcaaaaagctgcggtgatgggggcaaaaagccgtaaaaagccacagcgtcgggggcaaaaagccgcggtggcgggtgtaagaagccgcggcggcaaaaagatgcggcggccgggacagaaagccgcggcggcgggggcaaaaagcaggggtggcaaaaagtcacggcggcggcgggggaaaaaagccgcggcaggaaaaacctgaggcggcgggggaaaaaagccgctgcggcggggaccaaaagccccaaaaagccgcggcatcgggtgccaaaagccgcaaaaagccacggcgaaggggctaaaaagccgcaaaaagccgcggcagagggggcaaaaagcagcggaggcaaaaggccacgacggcgggggcatgaaaccgcaaaaaccctcggcggcaggggcagaaagccgcaacggcgggggcaaaaatcaacgggggcaggtgcaaaaagccgtggcggcaggggcaaaaagcaacgggggcgggggcagaaagccgcggcgaggggggcaagaagccgcggcggcaaaaacccatggcggcgggggcaaagagcggctgaggtgataaaaagctgcggcggcgggggcaggaagccgcgtagggggcaaggagccgcggcggagggggcaaaaagcagcaaaaagcccaggcgtaggggcaagaagccgtggcaggaaaaacctgcggctggcggggggaaaaagccgcagcggcgggggcgaaaagctgtaaaatgccgcggtggcgggggccaaaagccgcggcggcaaaaagccacataaagccggggcggcggggcaagaagccgcagcgggagaaacctgcggcggcgggggcaaaaagccgtaaaaagctgcggtgctgggggccaaaagccataaaaagccgcggtggaaaaagtcgcggtggcggaggaaaaaagccgcaaaaaccgcggcagcgagggcaaaaagccgtggcttccggagcaaaaagccgtggcggcgggggcaaaatagtggaaatggtgtagaaggccagcacagcttggcattcctggagtgttatgtggaaggaaaagtgcagaggaagacaaacaaagatgtaagtaggcttgactcagtgcaactaagaacccagatgttatctatcagctaattttttgtattttagtagagaaggggttttaccacgttggccaggatggtctcaatctcctgaactcatgatccgcgcacctcagcctcccaaagtggtgggattagaggcatgaaccacaaagtgctcaaaaaatctattaattaaaaaatgtgtatgtagccatctttaatctaccatgtccattagcagataagtactataagcaaaataacaacaatgaaagaaacattgacttagagtagatactctgatttatttaataaaaatttgaaaatagaccaaattatgacaaaaaaaaaatctgttactattgaggatgagggttagtgtttggaaaggggcaggagaagtatctctatttttagtaatgttctattttcatacatggttataagcaaatacatgtgtttcattaatcaagctatctatatttaatcattgtacttttctgcatgtatgatatatgtcaataaatgtcttaaagtatatacagcaaaaatagacaaaaccacaagaagacatacacaaatgttaaacctagagagaaatttgaatataagtaagtctctgaatgactggtagaacaaaccgaaaaataggatggagaggtttggaacagcatgattagcaaaattgacatatctgtcttttaatataggcagaaacatagttagataaaaaaaggacttgtctcggagcatgatttctgaaaacagtggaatcgagtttgaatctagtaagtacatataaataaatgtcttaaaactcctcttatgttagctaattaagaaacactattgtaatagacattagaaaatattttaataaattgagtggatttcacacgctaaggaaatgatcttacttgcatttgatagttcaattagatacatatatacctataggtagtttaaaatatttctaataaccttatatacttttaaaaagcattgatatctgtttgcactatatggtctatagagtacacataccaaacatgattatagctcttctgctataaacttcaaatgtctaattaatacaaaaatctagaatgagaagagttctttgcatttttttttatcaaatagaatataggaaagatagctgcaaatatacctgacacacttatctgtgagtatggtggtagcctttttattttattttattttgagagagggtctcactttgtcacccaagatggagtgcagtcatgtgatcagagctcactgaagccttcacatactgtgctcaagcgattctcctacctcagtctcctgagtagcagggactgcaagtgcatgacaccatactagctaatttttgtaaagatggggtttcaccatgttgccctggctgatctccatctcctggactcaagagatctggccaccttggcctcccaaagtgctgggattatagttttgaggcaccacaatcagcccagccttaaaaaaggctgactagagatctttatctatgtatatctatatctatctataaaataaacatatgtgcttcttatataaaaatatatattattaatattatataaaatttttttcaaggtagaaatatataaagagggtgcatgtagagcctggggcattgtgtagtgaagctcaaggcctctgaagaaatgccccttgcctcttttgtctgggctagaatccgagaagggaaagcagcagatgcactggttcccaggttcttggcatcctacagagagaaacttgtttgagctagggtagcgttaaacacccttgttcttactctcctgttttatatagtgagcagagactagcttcatgagaacagactgtgacagtcaaggctgtctgatattttgtgcagcattaattgagaaattctagcacctgaagaactctgggccatttgagggtaggtgcaggggaggaaagggaagtttgcatccctcctgctgtggagagaacccgtgggaagcacagaccttgtcctaactgaaggcagaccaccttgctaaccagcttctcatcagccaaccctggatgagtttctatgtctatttactaaataatccttattgcttttcttcatatgggcaaagtatggtttacagggaatattgttcctttgaacacccatcatggaaaacccttcctgttgtgggaaaccaggcttccatatgtgtattattgggaaacacataggcaatttctatgtttttactgcatctatttcagggatatgggaactgaatagtgcccatcaaaggctcacctgatgttggaaattgatctgagagcgcggaaggacagaattctttctttgttcctgggcagcggtggttgagggatcattttgtggcagctacagtggcaatgatggaggcataatggcgggctcagtaccaagacaaggagagacttggcctcacaatggcagcattgcaggggtgcgctctacagaacatttgctcacatggttttgggcattgtctctaactacattgcttccccaataggttgacccattctaactaactccttttctctttaaaaaagcaaacttcatttgtatgacttgcaattgtaaacgacaccaattggccagttatcattcaaattctctgttacttaatcctgccttttcctgacgtatgcaactttcccctaaaaaattggacactttgttgcttactcattgtctttacacattttaaaatgttgctttatgcccccaatccctaactacattttcaatgttttgcaagtggagtccaggtgttcttgatttacatgaagctcaaaataatggttatagtaagtagtacttcataattaagcaaaaagctcttattgaaaaatgacagaactatacatagggatgacaacatggagagatatttcgtgagatcacaaagttatggtatggcagaagtagaatgctgaatagagactctgtgttcccaatcattatttctaccaccagctttctattttgatgttaataatgttcttatgtgggaaaccctacatatttgccaatgtttagttcattgacaaagaaatagaaagagcttcaagaacactctaatatttaaaaaataaaatgtctataattggccatacgaaaaaattggtacttgacatatactgagatcgttttattttgtgctagacaaatgaagtcatagaacagaatgtgctttaaatattatgaatagtgcttgcatgtgtgcgtgtgtgtgtgtgtctatagatgcatattaggccgttgaaaagttttattattctttcgaggagagagactgccaacttttgaacctaactagaacaagtatattgcttcttcatattttgattaaggcaaagagaatctagttaaaaataattcaacttatcgtggaaatgctataaattgctgtgaagtgagttgctggttatggcttgtcagagcaaatatattgtacaaatcttaggggagaattagtgcttatacattcaaatcaaatcatcttgcagcagactgagaaaaacgttagatttttaaaataatttcaaagtcatgaaaagagcaaatatgctccacaaagagcctagcaaccctcaatgaccaatgcccctttaatatagtttggtatctgaattagaatcccagaatctacaaatacctctgggtgtgggtgctgcattttgaggattttataacactgccatcaccaagctctcttttgatattcactttaaggagataatttacgggcaaccagagagcataaaccaaagtagatatctatctagatagatagatacatctccatatcattgacaggatacattctagccgagtgtgagtacaatctatggatgtggttggagagaacatgtgttccacctgagtggcagatcaggattattccttctcatctgctgcaatggctcaatgtgttaaggagaggagcgagacagcaagaactgcattcattcagtcatacagaccaaaaggaggaatgtcgcccagccctctaaactgacccagaacccagctcatgtctcaactgctacctctactacttagaaagaagtaactccactaaagcagggttctggacaaatatatttttattgatcatatacaaatagatgaagatggacttggatgttaagaaaaataatgctatacaaaatcgagagtagagagtcgcccctagacttaaattaagggtgtgtacattagataatttaatccaatctatcaggtaaaaacttgaacaaaccttttggcctcttccttaaaattcagggaagtatgtcctccacaaaacagaatcaaaatataaataaaagactggcttaagatgaaaataaaccttacaaatgaaaagccagatgagaggcacttaactgagaatgaaaagaaactgagcggacaaaataattatgagaagatgaaccttcaaatcagaaagagggaaaaaagcttatttgatactatgagaactcaaaagagagtgaacacaagtgtgaaaattccaagagtaaagaaaagtagcataactaaattaagagcatgagaaaatgtgtacaattttgagtaataagagcggaaatccaaagtacctattgtatgtgatattttagtagagcaacactgaagaagaatgaaaacaagaaataatattaaatatgaacatatggagaacagaataatatttttaaattttttagtttctaagcttatctgaaattttaattttggtttcttatataataccagagttattaggaagttattagctaataacactattttcagtgatattttaagtatttgtcctagaaaaatttctatttttgaaaaatgtatatttaaaaatacattaaatgtgtatatacatcaatcatatgtatcgatttatgtttttctttaattgcaaatgaaatttgtatttttgtgttcctggaataaaataaacttgaatggattgtaatatattattcatgctgtaattcaacgtatttgaattctttaagaatgttacatttatagttaacagatattgattttctgtcataatgatgttgtgagacaatctaagaggaattaaaatttaaattcatgtattcctcctttttcctctgttctctaactgtaatatattttaattacagatggaggaacagatagatgttagataaataggtatataatatatagatcatccaaaattcttattcttatggttttatgtagtcagtatttacctctatttttctgcatgtttatcattccaatttagttcattacttcctgcacctttgatgtcatatatataaacaggaaataacacatggtggccgggatgtagagagagccacaggacttgtgaataaaatccacaggcaaggatgtggcgattccttttgcaatattggagggaatgccaaaccctatgtttgctgtggaaaagagtatgttagttcctcaaaacatcaaaatggtattgccatatgattcagcagctccacatctcaggatagcaaaagaaatgaaagcagagtcttgaaaaaatatttacacatccatatttgcagcagcattattggcaatagctaaaacgtagaagcaattgaagtgtccaacaacagatgaatggataagcaaaatatgatatatacatacaatggaatattattcagtcttaaacatgagggaaatattctgacatatgttgcaacttggatgaaacttgagaatattatgccaagtgaaataagttagtcagtgaaggacaaatacagtataattccatttgtataaggaacttaaagtggacagagtcacagagatagtacaatgatggttgccagaagctggggggaggaagacatggggaagtattgcttaatgagtatagagtttcagtttcacaagatgaaacgagttatggagatggatggtggggatggctgcacaatgttatgactatatttagtaccactgaactgtgcacttaaaatggttaacagagtacattttatgttatgtgtattttaccacaataaaaaaataaaataccttaggaacattttcctgaaagagtccacataaaattcattttaatgcatgtgtttatgcatagatttctatttttctcttttctatttatattccaaattagaatataatgctaatcaatcatagtggctgtgtttcttccttcctctagtctgcaagtagcaagcaaatgtaataaactacttattcatgtcacacctatttattttctgccttataccaagcttgtgggattctattaaatacaacatttttatacgtacacctatgcaatacccattagcatcgccttcctaaatcaggggaaattgagtgtctgtaaggtgcggtaacttactaagatacaaaactcagcattaaagtctgtatacttcaatatcctgccctcttctcatttgtctttactgccttttatgtatgtgttagatgttcaataaatactcttttttaaactgaa

SEQ ID NO: 12734 - DNA, 6002 bp, Homo sapiens
ctgtaagttttagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatattccccttcctgtgtccatgtgatctcattgttcagttcccacctatgagtgagaatatgctgtgtttggttttttgttcttgtgatagtttactgagaatgatgatttccaatttcatccatgtccctacaaaggacattaactcatcattttttatggctgcatagtattccatggtgtatatgtgccacattttcttaatccagtctatcattgttggacatttgggttggttccaagtctttgctattgtgaataatgccgcaataaacatacgggtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattcgaaccggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcggatgagttggttgcgaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatccgttcctcattacttgtttttgtcaggtttgtcaaagatcagatagttgtagacatgcggcgttatttctgagggctctgttctgttccgttggcctatatctctgttttggtaccagtaccatgctgttttggttactgtagccttgtaatatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggctattttcatgatattgattcttcctacccatgagcatggcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttatcaaaggctttttctgcatctattgagataatcatgtggtttttgtctttggctctgtttacatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattgaaatagtttcagaaggaatggtaccagttcctccttgtacctctggtagaattcggctgtgaatccatctggtgctggactctttttgattggtaagctattgattattgccacaatttcagctcctgttattggtctattcagagattcaacttcttcctggtttagtcttgggagagtgtatacgtcgaggaatttatccatttcttctaggttttctagtttatttgtgtagaggtgtttgtagtattctctgatggtagtttgtatttctgtgagatcggtggtgatatcccctttatcattttttattgcgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggcatttagtgctataaatgtccctctacacactgctttgaatgcgtcccagagattctggtatgttgtgtctttgttcttgttggtttcaaagaacatctttatttctgccttcatttcgttatgtacccagtagtcattcaggagcaggttgttcagtttccgtgtagttgagtggttttgagtgagattcttaatcctgagttctagtttgattgcactgtggtctgagagatagtttgttataatttctgttcttttacatttgctgaggagagctttacttccaagtatgtggtcaattttggagtaggtgtggtgtggtgctgaaaaaaatgtatattctgttgatttggggtggagagttctgtagatgtctattaggtccgcttggtgcagagctgagttcaattcctgggtatccttgttgactttctgtctccttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctctttttatctttgttgctttaaagtctgtttcatcagagactaggattgcaacccctgcctttttttgttttccattggcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgctagctggttattgtgctcgttagttgatgcagtttcttcctagtctcgatggtctttacattttggcatgattttgcagcggctggtaccggttgttcccttccatgtttagcgcttccttcaggagctcttttagggcaggcctggtggtgacaaaatctctcagcatttgtttgtctgtaaagtattttatttctccttcacttatgaagcttagtttggctggatatgaaattctgcgttgaaaatccttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtaaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcctggaggctttgctcatttctttttattgttttttctctaaacttcccttcttgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatatattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacccggccctgtgaggtgccccgctggggggtgcctcccagttaggctgctcgggggtcaggggtcagggacccacttgaggaggcagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccaccttgcagtttgatctcagaccgctgtgctggcaatcagcgagactccgtggggtaggaccctccgagccaggtgcgggatgtaatctcgtggtgcgccgttttttaagcccgttggaaaagcgcagtattcaggtgggagtgacccgattttccaggtgcgtctgtcacccctttctttgactccctttgaaagggaactccctgaccccttgcgcttcccaagtgaggctttgcctcgccctgcttcggctcgcgcacggtgcgcgcacccactgacctgcgcccactgtctggcactccctagtgagatgaacccggtacctcagatggaaatgcagaaatcaccgtcttctgcgtcgctcacgctgggagctgtacaccagagctgttcctattcggccatcttggctcctcc

SEQ ID NO: 12735 - DNA, 11538 bp, Homo sapiens
caagaatttgtactctaatgacacttttaggtgatcttacatatcaataaagttaaaggctggctatgagtattctaaatcattagccacagttatatacttaccatattttaagtcttataacacaaacatttgtaagattttaatactatatccatctatgtttccaacattgtcaactcctagtaaacaatatttatcttgaaggaatcctgcataatttagataaatttaaaatttatctcaaaagccactgctttgatttcagatgcaaaaaaaagttttcatgtttagttttaatacaaccttcatcttcatttattctgtggtctttttttttttttttattttgtacctccactggtaggtttttttttttgttttttttttttaatttaagttttagggtacatgtgcacattgtgcaggttagttacatatgtatacatgtgccatgctggtgtgctgcacccactaactcgtcatctagcattaggtatatctcccaatgctatccttcccccctccccgctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcatgatttatagtcatttgggtatatacccagtaatgggatggctgggtcaaatggtatttctagttctagatacctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacatctcatagtggttttgatttgcatttctctgatggccagtgatgatgagcattttttcatgtgttttttggctgcataactgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgtagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaagcggcgttatttctgagggctctgttctgttccattgatctatatctatgttttggtaccagtaccatgctgttttggttactgtagccttgtggtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcactgaatctgtaaattatcttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctcttgttggtgtataggaatgcttgtgatttttgtacattgattttgtatcctgagactttgctgaagttgcttatcagcttaaggagattttgggctgagaaaatggggttttctagataaacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttacagaggattccctctttttctattgattggaatagtttcagaaggaatggtaccagttcctccttgtacctctggtagaattcggctgtgaatccatctggtcctggactcttcttggttggtaaactattgattattgccacaatttcagctcctgttattggtctattcagagattcaacttcttcctggtttagtcttgggagagtgtatgtgtcgaggaatgtatccatttcttccagattttctagtttatttgcgtagaggtgtttgtagtatcattttttgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgctagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagacgtctattaggtctgcttggtgcagagctgagttcaattcctgggtatccttgttgactttctgtcttgttgatctgtctaatattgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattgcagaatttagtccacttacatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcagttttcaacttctttgcctttggtttgaatgtcctcccgtagctcactctaatttgatcgtctgaagccttcttctctcagctcgtcaaaatcattctccatccagctttgttccgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctctgtttacctaagcaagcctgggcaatggcgggcgcccctcccccagcctcgctgccgccttgcagtttgatctcagactgctgtgctagcaatcagcgagattccgtgggcataggaccctccgagccaggtgtgggatatagtctcgtggtgcgccgttttttaagccggtctgaaaagcacaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcatgctgggagctgtagaccggagctgttcctattcagccatcttggctcctccctattctgtggtcttaaagcatctatctcagtctttttctacttatacactcaagaaactagcctggagtattggcatgatttattatggacaagaattttccaattcgtttagagtgacagggcccaaaatccttagttgtaaaggagtgcgacaagaactatatcatcctaaataaattccaaaatcagaaactcaataatagcttcaaactattcctaaaagtcttcacatttattttagcaaaatatacttagagaatttacatctttcttaattgtttactgtaaatcagaatccccccgacacacctgagagctatggtccctgctggtgtgcatttccacatcaaacatgatctgcccatcttcttgtggcgaagggctagaagagaaggaattcagctattagttttaattctcactttgtcaaatgacttagtctctactagaaattagaaaattaaaagttacagcagtatggctttgaaaaagcaaatcagagaatatatcataaccctatacaagaaaaatttatgtgatattaaaaggctaaatgaaattgagcattcttactcccaaaatgttctgcactttttcagtagtaatgaaatccttcaaaatgataaatttgcaaaggaaatactatctacagacacaaactgtcacattctcttatatttactcttttgtccactaaaggtaaaataatcttcaaattcaggaacttcagagttctttttctcaaagttccctcatcattaaataattcaccagtagttctcaaagtgcataaggtagttctcaaagacgctttcagagggtctttgaggttacagttcctttctcaatactagtaggatttatttgcctttttcattctcattctcccatgtgtatagtggaattttccaaaggctacatgatgtgtgatagcacaacagttagaatgcaaacacagatgagaaccagctgtcttctattaagcttggtattagagatttgtaaatgtgtaaaacaatgccactattcttattaacttggagggtttatagaaaataggtattttcactaaaaaatgctacttatgttaaaatgtattatttttgaatgaatatatattttctcagttttaatttctaatatagtaaatatcaaaatatataaacccacaaacaagttttttggggtccctaatgatttttaagaatgtaaaggtatgtaatgaccaaaaactttgagaaccactattttacttatttcagaaatatttgctttgagatatttcagagtgaattatataacttatatattaatataaaacctttatgattgcacaaaatacattcttagaactgtaaaaatttacaaataagtttttagacaaaaacaacatgatcacaaactgcacttgatacaagagatgaacagaatgtgctaagttaatttcttagctttattaatgatttcttgtataaaaactgaaagtcactggggatccttcactacatacacaaaccctcccccaaaatctaaaatagaaataaaaaatatttggggcttaacttgctgaaaagaatagatattaactattaaagttatcaagagtatgtatataatgttaattaatgtatagagacgttggtgagactgactcagaaataagatcgtcagaaatttatcagacagattaggcctaggagtcttttagactagtataattgacataggagatttttaaatggggacaggaaaacagaaaagctggttctgtatcaaaccaacgtcatatatatttaggaaatttttgtcttgaactagcacaggagtcaacccgaactgggcactcctactggcctcagtttactatctttgtgctcataactgttgggttcacagctacacatcaagttaagggtcagccttacatagccgtgaccaggtcaaggcagtcagggtgacaaagtcaagaatcctatggaagcattgctctgcttctatatgcttcttcacactggtaccaacctcttctctaaactgtttactcctcctaacaatttggaatgcattagagcttcacccatggcacatattagaatcggctggggagcttttaaaatattgtgacgtctctaccctgcccctgtcaaccaaaatgagaagttcttgagatgcagtccatgtgctgccatttttaaaagcttctgggtgaatctagtgtgccgtcaaggtgaaaacccctgtgacagggtgaaaggcaaagcagaacacactggggttcccagctaacaacccctgcggcaacacaaatatttctatggaataatttttaagttgaaaatatacataaatcagctctaggactgatacccaacaaccctaaaacatttccccctacaagaaacactttccaattacttttcacatatagagacgcatggcaattcagatgatgtgagttttgaagacactcctcaatggtaaagcgtgttagtaggctatcccagaagactcgagttctagccattctctgaaagatgaccactaatctagggcctggagagacataagatgaggggtacgaaagtgttcaaaagcatttgccatgcctcctcatggcaacctaaacttaaacatgatcataggagggtgaaggcatattcagtcacacgtaaaactgcaccataaatgaagtaagatgaacagacaggtaagcaggtgactgttctctgctcattgacagcaccatgtgaacaacaggctcatggacaccatggtatcaatgatcaaggcccacacacctgaacgcagagtgaaagccttgttgacaggccataacaagcagaaaacttgagaaacccatcagcaagttccataatataaatataaatcttcattcggaaagacagactaatgctgtagctactggaatcaagggcaagctgttcagaagagagccatctgctctggttccgcttatgacaagagccatcccaggctctaagaagcacagggacaagtcagggatgacacgggggtggcgggggtgcacagtgtgccacagagccaacaaaccagtcccccgctgccttggcaacattagtggatcataagccactcaggaagttggacatgatttaactcatttctcctttttttcacttcttctgataagtaataatatgtgcaatatacacaatttttacaaaatacaaaaatgttaagaagaaacatatccatactgcattcctaaaaatagtcactgtttacatttccttaatctgcttcccgtgcatttgcattttctaaatggttaacatcagttaacaaccacccagaaggtcatccagtgccccataatgctaacagtgtagctgtcactgaaacaagaattttttaaatgtcatttaatatctagcccttttgaaaaaaaaaaaaaaaaacagaaaagtttatactaaaaaataatgacctggtttcattccacacacatatctcgttgtattcttactctttcaccataagcagtccttaatccatgtaattagtttcttcagctcaaatatagaaaaatgaggtctgaaacaaaacatcccctgagaaagcagaggagacttcaaaactatctttacagaccttggttggtgcttccaactgtgcaaatattgctataacgtgaagcaacctgcagttcctatgaatcaaacatttactgagtgtctactacgtgccagcaccattactgtgaaggtaataaaaattaaacatggcccctgccctttgcaacgtcaacatctagaagggaagacacatatatacagaggtaactaattcaagaacagtctgtgatctgtaacacagggacacaaaggaaaatgggggaaagtcagattaattctataaattagcatttatgccactgaattttaaactgataaactgctagaaacaatataatctgggtaagaaaaatgacaatctggggaaaaacagtgggcactgaagcacctgtcaattagctgtctcatataaacacaatatatatctgtgcaatatatattatactacaatatatcaggaggcatattttgctaagtgaagatttaagcaaacagatttttcctagagtgaatgagccctgtaacccacctgtttcctgaattccaccaaaacatgggtctcacttacctgtcacagtgagaactgcctctggaactactctgtcctgattcatgttgtgcatccaaaagaatcttctccatgtctccattgtggatggaggatgaggatggtacgtgttccagccccccatttttcccattgccattatcattgccattgctgctgttcatgggtagctccacccaggaacctgttggacaagtcagataagttaaccacagcagaactgaaatctgtcatgtgcacacagatgtgaacatggtgaatccagataagaattctgactctcctcaaaccaaatgtaaaagtattctgaagaaaataaataagaagtaataaaagtctaaagatctatatagttctgttcctgaaatagctcatgccatcaactgagaaacagctcaaactctaaaacatctcagaaaacgtgtttttcagtcaatttctctctgggtaaagcttggtttataataacactctactgaaaactcaggttgcttttcaaaaaaaaattgctacttttaggctatttacctttaacattttagttggtgtatatatacacacacactttcttcatagtctacctaagctgctcagctgtatctgctccagaaatgaaataaatatatcacctacaaatttcataaaaggtcatctaagtaagttagcaactatatcctacttagtgcaaacaactgagaaactcctagagagggaacctaaatccaatagcaaaaatttcaatttgtgcacaaatcaggagcataaaattaatgcagctggttaactaaatcaggtaataatgctaaaaattcagaaaaaagctttatctctatctcactgattagtttcttcatttcctttgtatctcaggctttctagtccttctccttttttatacactaaacataccttgtgaacttgtcttttttcttttctctcccacgggtttctactttctagggttttcattaaaccctgttgatttgggagcagaaacaactgcacatcagc

SEQ ID NO: 12736 - DNA, 9730 bp, Homo sapiens
tgaactcatcattttttatggctgcatagtattccatggtgtatatgtgccacattttcttaatccagtctatcgttgttggacatttgggttggttccaagtctttgctattgtgaataatgccgcaataaacatacgtgtgcatgtgtctttatagcagcatgatttataatcctttgggtatatacccagtaatgggatggctgggtcaaatttttaaatatttcaaaggttaccatcacaaggcagttaaaatttgtattatgaaatattttcaaacacatataaaagagagaaaataaacaccagtgtacttgccaatcagctttgccaaacccaaatattttgcaatatttgtttcaaatattgtttttaagaagtaaaatattatagaatgcagctaaatttcctcctccaacccgtctcatttatcttcctcccgcccaagatgtaaccactatcctgaattcaacatttctcattaacatgcacactttttgtttttgctaaatatgtgtgtatatattgtgttctaaaactcagtttaaatagtgtcataatacttacagtactctaccatttttcttaccacattagatttatagatttatttttcagatatatctattttgatgcatgtagccagtttattatctcaacagttttaatgtcattatattgaacatatcactatatataatacacacacagataaataggtaatatagacagaaaaaaagataggtgaatagagagaagatagatagatagatagatgatagatagatagatagatacatacatacatacatacatacatacataaatatgtagataactattcctccgttaatggatatttaggttgtttccaattatttgctattacatatctcaccaacagtggttgagaattttaattgttccacgtgcttgccaactactggattttcactttgggggagtactgcctatctaatacgtatggcataaaacttgattgttgtttccatttccctgatactagcaggattgaaaataaatttcatatgtttgtgggcctctcagggttcttctgtgaatttctgcttcacattattcacccacttttctctagttgtttttatatattccagacctaaccattttttgttatatgctttactaatgtccaccactccctggaatgtctgttcactttgattctgatgccttttattctatgaaagtttttcattttaatgaaaaccgattcatcaaaatgttccttttttgcttacgttttttgtgtcttattttttaagctctgtcctgcttcaagtttaaatttctaccaaaagtattgatgttttactttttacatgtatgtgttccataaaaaatccactgagcagatccactgctcaagttctataaaaaaactacagaaatgttgattggaattgcatggaatttgtggattaatttggagaaaagtggtatctttacaatagcaaggctttccatctatgcatttgtatctcttttaatcaagtcttaatttgtgttgtggcagattccgctacttgccttctcaacaaactgctttcttccttgataagaaaatacaaatatgttttagagatggcaatgtgttcagcttcaggtgacgaatacacagtaggcattcaataaatagcacctacttaattatcatcatccccctggtctaccatttggtaaccaaagcgaaataaagttctaagcaggggtcagcaaactacagcccacagttagtctgacccacttacaatttttatgaagaagtttttctggaacacagccaggcccatttgtttacatgttgtctatgtctgcattcgcactagagcagcaaagttgaatgattgcaacagagactatatatagccaccagagcctatctggccctttcacagacaaagttggccaatccctgccttagacggtattctttgcgagatattggtttggaaggttctattcctctatgccagatgcttattgttccatactttgttgcaactaaaagtgtccatggggcccaatgttggctgaatgtttctggaaagacttttaaactcctgataaacgtaatgaccataaaagaaaagcttgctatcaccaactcttccatctatttcctgcctcaaacacagatttgatgcctggaactttgagagctactttgcaattatggggtaactcttatggggggaagagctagagggcaagcaataagcttaaggtggcaggcagagctggctatataatttgcaaatcccaataaaaaattaaaatgcagggcctcacccaaaaagcagaaaaaagtgtcattaaaggtactaaaatataaagcattttcctttcttccatggactctttctcaacttgccatagcatttttttaatcttttcaagacaaggtctggctctatagcccaagctggagtgcagtggcagtgtttcgcctcactgcaacatttgcctcccaggctcaaaccattctccaacttcagcctcccaagtagctgggactacagatgcatgccaccacgatgggtgaatttttgtattttttatagagatctggttttgccatgttgcccaggctggtctcgaactcgtgagctcaagtgatccgcccccctcggccttccaaagtgctaagattataggcatgagccactgtgtctggctccatagtgttttttatttactacttgatgatgttatcagtaaagaataaaatttaatttattagcatgaattttatcattgcagtttatattgtttaatgccagtgttaaatgcaagagcatttgatttatatacagaatcaccaacattatgctacttgcatttcttaccttgtatacgcatgcatgtgtatttctttcttaccaaacactgaggacactgcacaagacaaactcaattgtctttatttcatgttttgattcacacacatagtcccaaaattctctactttccacttactgatgagtaaggaagggactgaaaggaaaaggtacaatgcattgccctatttttccctttcctttgatgccatcatttttggtataaatgaaatggctaatatagggacgtgacatgaaagtgaaaggatataagactccttgcttatttatagtccttagaatggcactgccttctttttatatttgaagcaagttttcgtttaaatgaaaagtgtagccgctctggaatatcatctcccctacttagtcatagatgtaacatgtttaacttgtgctcactttgagtctcaatgaactcccatgattcctgggtccactggaattcaatccttatgggacatcacaaagactatatgcaaatggaggggcaaggaatgacagacactcatattgtatgtatttcctctcattacacacatgttccactgtcccatcagagttcatttactcaacacaagtgcaaagataaaattttcaaggcattcaaacagcaacagcaagctttaaaccaagcaagagacccttctgagtttgaaccctatatgactttacaggtcacacgcccctgaagccactcttgatggcacagcaaaaatgggcaaagcctagaacaatgccgacattgttgagttgccacaacaaactaccttcagatatatatttttttaatttattattattttactttaagttttagggtacatgtgcacaatgtgcaggttagttacatatgtatacatgtgccatgctggtgtgctgcacccactaacttgtcatctagcattacgtatatctcccaatggtatccctccccactcccccaccccacagcagtccccacagtgtgatgttccccttcctgtgtccatgtgttctcattgttcaattcccatctatgagtgagaatatgcggtgtttggttttttgctcttgtgatagttttctgagaatgatgatttccaatttcatccatgtccctacaaaggacatgaactcatccttttttatggctgcatagtattccatggtgtatatgttccacattttcttaatccagtctatcattgttggacatttggattggttccaagtctttgctattgtgaatagtgccgcaataaacatacgtgtgcatgtgtctttatagcagcatgatttatagtcctttgggtatatacccagtaatgggatggctaggtcaaatggtatttcttgttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtcctttgcccactttttgatggggttgtttgtttttttcttgtaaatttatttgagttcattgtagattctggatgttagccctttgtcagatgagtaggttgtgaaaattttctcccattttgtaggttgcctgttcactctgatggtagtttcttttgctgtgcagaagctctttagtttaattagatcccattagtcaattttggcttttgttgccattgcttttggtgttttagacatgaagtccttgcccatgcctatgtcctgaatggtaatgcctaggttttcttctagggtttttatcgttttaggtctaacatttaagtctttaatccatcttgaattgatttttgtataaggtgtaaggaagggatccagtttcagctttctacatatgcctagccagttttcccagcaccatttattaaatagggaattctttctccattgcttttttttctcaggtttgtcaaagatcagatagttgtagatatgcggcgttatttctgagggctctgttctgtttcattgatctatatctctgttttggtaccagtaccatgctgttttggttactgtagccttgtagtatagtttgaagtcaggtagtgtgatgcctccagctttgttcttttggcttaggattgacttggcgatgcgagctcttttttggttccatatgaacattaaagtagttttttccaattctgtgaagaaagtcattggtagcttgatggggatggcattgaatctgtaaattactttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtatttcattctctttgaagcaaatattctctttgaatgggagttcactcatgatttggctctctgtttgtctgttgttggtgtataagaatgcttgtgatttttgtacattgattttctatcctgagactttgctgaagttgcttatcggcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcacattcagtatgatattggctgtgggtttgtcatagattgctcttattattttgaaatatgtcccattaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttggtatcaggatgacgctggcctcataaaatgagttagggaggattccttctttttctattgattggaatagtttcagaaggaatggtacaagttcctccttgtacctctggtagaattcggctgtgaatccctctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccattttcattttttattgtgtctatttgattcttctctctttttttctttattagtcttgctagcggtctatcaattttgttgatcctttcaaaaaaccaactcctggattcattaattttttgaagggttttttgtgtctctgtttccttcagttctgctctgattttagttatttgttgccttctgctagcttttgaatgtgtttgctcttgcttttctagttcttttaactgtgatgttagggtgtcaattttagatctttcctgctttctcttgtgggtatttagtgcaataaatttccctctacacactgctttgaatgtgtcccagagattctggtatgttgtgtctttgttctcgttggtttcaaagaacatctttatttctgtcttcatttcgttatgtacccagtggtcattcaggagcaggttgttcagtttccatgtagttgagcggttttgagtgagattcttaatcctgagttctagtttgattgcactgtggtctgagagatagtttgttataatttctgttctcttacatttgctgaggagagctttacttccaactatgtggtcaattttggattaggtgtggtatggtgctgaaaaaaatgtatattctgttgatttggtgtggagagttctgtagatgtctatcaggtccacttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgccttatgaatctgggtgctcctgtattgggtgcatatatatttaggatagttagctcttcttgttgaattgatccctttaccactatttaatggccttctttgtctcttttgatctttgttggtttaaagtctgttttatcagagactaggattgcaacccctgccttttcttgttttccatttgcttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttactcattagttgatgcagtttcttcctagtctcgatggtctttacaatttggcatgattttgcagcagctggtaccggttgttcctttccatgtttagcgcttccttcaggagctcttttaaggcaggcctggtggtgacaaaatctctcagcatttgcttctctgtaaagtattttatttctccttcacttatgaagcttagtttggctggatatgaaattctgggttgaaaattcttttctttaagaatgttgaatattggcccccactctcttctggcttgtagagtttctgccaaaagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggattatatcctgcagagtgctttccaacttggttccattctccctgtcacttgcaggtacaccaatcagatgtagatttggtcttttcacatagtcccatatttcttggaggctttgctcatttctttttattcttttttctctaaacttcccttctcacttcatttcattcgtttcatcttccatcactgataccctttcttccagttgatcgcatcggctcctgaggcttctgccttcttcatgtagttctcgagccttgcttttcagctccatcagctcctttaagcacttctctgtattggttattctagttatacattcttctaaatttttttcaaagttttcaacttctttgcctttggtttgaatgtcctcccatagctcggagtagtttgatcgtctgaagccttcttctctcagctcgtcaaagtcactctccgttcagctttgttccgttgctggtgaggaactgcgttcctttggaggaggagaggcgctctgctttttagagtttccagtttttctgctctgttttttccccatctttgtggttttgtctacttttggtctttgatgatggtgatgtacagatgggtttttggtgtgcatgtcctttctgttcgttagttttccttctaacagacaggacccttagctgcaggtctgttggagtactgggccgtgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaagttactgctgtctttttgtatgtctgtgccctgcccccagaggtggagcctacagaggcaggcaggcctcctggagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggcgtaggaccctccgagccaggtgcaggatgtaatctcctggtgcgcggtttttttaagcccgtcggaaaagcgcagtattcgggtgggagtgacccgattttccaggtgccctctgtcacccctttgactaggaaagggaactccctgaccccttgtgcttcccgagtgaggcaatgcctcgccctgcctcggctcacgcacagtgcgtgcacccactgacctgcacccacccactgacctgcacccactgtctggcagtccctagtgagatgaacccggtacctcagatggaaatgcagaaatcacccatcttctgcgttactcacgctgggagctgtagaccggagctgttcctattcggccatcttggc

SEQ ID NO: 12737 - DNA, 7359 bp, Homo sapiens
  misc_feature (5757)..(5757): n equals a,t,g, or c
tcccaaagtgctgggattacagatgtgagccaccacgcccggcttaattttcttataatccgaattatcatctgctggtttggaagcaatacatattaatattcattttagtatccattcttattcttaataattcttttgtttgaatgattttatttaaaaatttgttatttagtatttctaacttctttaacaaaggaacttgttgaataactcccattttagtctttttatctaaaaacaatattgttaaacacagaaattatattattttaatatggctattttcctttttttttttttttttgagacagacaggatcatgcactggcatgacctcagctcactgcagcctcaacctccctcagctcaagtgatcctcccactttagcctccccagtagctgggactacagatgcgagcccccacgtcctgctaatttttctgctttttgtacaaaaagtgcaagaagagatggggttttgatatgttgcccaggcttgtctttaactcctgggctcaagcaatctttctgcctcggcctcccaaaatgctggtattataggtgtgagccactgtgcccagctaactattttttattgttaattaaatttagtgatgttttattcatccctgtgcttagcattgtattttgaatcccacaacttctctcttggtttattttactttggactgaaatacaactttgtaattgatcttttttttttcttttagagacagactctcactctgttgcccagattgaagtgcagtggtatgattatagcttatgcagcctcgaactcctggactcaagtgatcctcctgcctcagcctccagagtagctgggactacaaggacctgttactacacccgtctacctttaaaaattttttttgtagtgaaggggtcttgctatgttgctgaagctggtctcgaactcctggcctcaaacaatctacccaccttgtaatcgtgttttttattttctgatgcttttacatctctggacattgctaaccctggagggactgcccctcccagggccaaccaatttgtagagttagtaaacaactcccccgagaataggctttctgtatgcaaaccaaccaatgaagagcccatttcccaatcacaggccctaatcaccctatggcccggtaccagataattcaggacatttccattccccatgaggattaaaagcctgctgaaaccattcaagctagccactcgtaagcctgcttcccctcctttgtccttttcttcccatagaaactgtaataaaaaggctcttacccacatttcctcctcactccctctgcccctgacccaccgtgccatgcctggcatgtggtacctccagtttctatctagctatgagtaaaacaaacttctttcttcatgacagccatttctgtgtttgtgtgtcttaccacacctgattaaagcaaaacccagtggcccttaaaacaaaccatgcctttagtgagaatctatcggtggtgagccctcttagttttttggttataaaaacttttattactcctcataaatgatagtttatgtggcataaaattctaagttgacagtttttttaccctcagtcctttggaagctgttcctccattttcttggctctcattttgctgatgaaaagtcttccatcagtttagttgttgcgctcttagcaatttatatttcctttctggtagcttttaacattttattttattttattatcttttattatactttaagttttagggtacatgtgcacaatgtgcaggtttgttacatatgtatacatgtcccatgttggtgtgctgcacctattaactcgtcatttaacattaggtatatctcctaatgctatccctcccccttcccccgacccgacaacaggcccatgtgtgaaatgttccccttcctgtgtccatgtgttctcactgttcaattcccacctatgagtgagaacatgtggtgtttggttttttgtccttgcgatagtttgctgagaatgatggtttccagcttcatccatgtccctacaaaggacatgaactcatcattttttgtggctgcatagtattccgtgatgtatatgtgacacattttcttaatccagtctatcattgttggacatttgggttggttccaagtctttgctattgtgaacagtgccgcaataagcatacgtgtgcatgtgtctttatagcagcatgatttataatcctttgggtatatacccagtaataggatggctgggtcaaatggtatttctagttctagacccctgaggaatcgccacactgacttccacaatggttgaactagtttacagtcccaccaacagtgtaaaatgttcctatttctccacatcctctccagcacctgttgtttcctgactttttaatgatcgccattctaactggtgtgagatagtatctcattgtggttttgatttgcatttctctgatggccagtgatgatgagcatattttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaattttctcctattctgtaggttgcctgttcactctgatggtagtttcttttgctgcgcagaagctctttagtttaattggatcccatttgtcaattttggcttttgttgccattgcttttggtgttttagtcatgaagtccttgcccatgcctatggcctgaatggtattgcctaggttttcttctaggatttttatggttttaggtctaacatttaagtctttaatccatcttgaattaatttttgtataaggtgtaaggaagggatccagtttcagctttctccatatggctagccagttttcccagcaccatttattaaatagggaatcctttccctatttcttgtttttgtcaggtttgtcaaagatcagacagttgtagatatgtggcattatttctgagggctctgttctgttccattggtctatatctctgttttggtaccagtaccatgctgttttggttactgtagccttgcagtacagtttgaagtcaggtagcatgatgcctccagctttgttcttttggcttaggattgacttggcaatgcgggctcttttttggttccatatgagctttaaagtagttttttccaattctgtgaaaaaagtcattggtagcttgatggggatggcattgaatctttaaattaccttgggcagtatggtcattttcaactacccatgagcatggaatgttcttccatttgtttgtatcctcttttatttcattgagcagtggtttgtagttctccttgaagaggtccttcacatcccttgtaaggtggattcctaggtattttattctctttgaagcaattgtgaatgggagttcactcctgatttggctctctgtttgtctgttattggtgtataggaatgcttgtgatttttgtacattgactttgtatcctgagactttcctgaagttgcttatcagcttaaggagattttgggctgagacgatggggttttctagatatacaatcatgtcatctgcaaacagggacagtttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattgagtatgatactggctgtgtgtttgtcgtagatagctcttactattttgagatatgtcccatcaatacctaatttatggagagtttttagcacaaagcttgttgaattttgtcaaaggccttttctgcatctattgagataatcatgtggtttttgtcattggttctttttatatgctggattacgtttattgatttgcgtatattgaaccagccttgcaccccagggatgaagcccacttgatcatggtggataagctttttgatgtgctgctggatttggtttgccggtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatttggctgtgaatccatctggtcctggactttttttggttggtaagctattaattattgcctcaatttcagagcctgttattggtctattcagagattcagcttcttcctggtttagtcttgggagggtgtttgtgtctaggaatttattcatttcttctagattttctagtttatttgtgtagaggtgtttatagtattctctgatggtagtttttatttctgtgggatcggtggtgatatctgctttatcattttttattgtgtctatttgattcttctctcttttcttctttattagtcttgctagcggtctaccaattttgttgatcttttcaaaaaaccagctcctggattcactgattttttgaagggtttttgtgtccctatttccttcagttctgctctgatcttagttatttcttgccttctgctagcttttgaatgtgtttgctcttggttttctagttcttttaatggtgatgttagggtgtcaattttggatctttcctgctttctcttgtgtgccgtagtgctataaatttccctctacacactgctttgaatgtgtcctagagattctggtatgttcgtatctttattctcattggtttcaaagaacatctttatttctgccttcatttcgttatgtacccagcagtcattcaggagcaggttgttcagtttccatgcagttgactggctttgagtgagtttcttaatcctgagttctagtttcattgcactgtggtctgagagacagtttgttgtaatttctgttcttttacatttgctgaggagtgctttacttccaactatgtggtcagttttggaacaggtgtggtgtggtcctgaaaagaatgtatattctgttgctttggggtggagagttctgtagatgtctattaggtccacttggtgcagagctgagttcaattcctggatatccttgttaactttctgtctcgttgaactgtctaatgttgacagtggggtgttaaaatctcccattattattgtgtgggagtctaagtctctttgtaggtctctaaggacttgctttatgaatctgggtgctcctgtattgggtgcatatatatttaggatagttagctcttcttgtttaattgatccctttaccattatgtaatggccttctttgtctcttttgatctgtgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagttcatttacatttaaggttaatattgttatgtgtgaatttgantcctgtcattatgatgttagctggttattttgctcgttagttgatgcagtttcttcctagccttgatggtctttacaatttggcatgtttttgccgtggctggtactgagtgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgaggtttctctctggctgcccttaacattttttccttcatttcaactttggtgaatctgacaattatgtgtcttggagttgctcttctcgaggagtatctttgtggtgttctctgtatttcctgaatctgaatgttggcctgccttggtaggttgggaaagttctcctggataataacctgcagagtgttttccaacttggttccattctccccgtcactttcaggtacaccaatcagacgtagatttggtcttttcacatagtccaatatttcctggaggctttgttcatttctttttattcttttttctctaaacttctcttctcgcttcatttcattcatttgatcttccatcacgataccctttcttccagttgatcgaatcggttattgaggcttgtgcattcgtcacgtatttcttgtgccatggttttcagctccatcaggtcctttaaggacttctctgcattggttattctagttagccattcgtctaatattttttcaaggtttttaacttctttgccatgggttagaacttcctcctttagctcggagtagtttgatcatctgaagccttcttctctcaacttgtcaaagtcattctccatccagctttgttccattgctggtgaggagctgcgttcctttggaggaggagaggtgctctgatttttagaattttcagtttttctgctctgttttttccccatctttgtggttttatctacctttggactttgatgatggtgacgtacagatggggttttggtgtggatgtcctttctatttgttagttgtccttctaacagtcaggaccctcagctgcaggtctgttggagtttgctggaggtccactccagaccctgtttgcctgggtatcagcagtggaggctgcagaacagcggatattggtgaacagcaaatgctgcctgatcgttcctctggaagttttgtctcagaggagtacccggtcgtgtgaggtgtcagtctgcccctacttaggggtgcctcccagttaggctactcgggggtcagggacccacttgaggaggcagtctgtccattgtcagatctccagctgcgtgctgggagaaccactactctcttcaaagctgtcagacagggacatttaagcctgcagaggttactgctgccttttatttggctatgccatgcccccagaggtggagtctacagaggtaggcaggcctccttcagctgcgg

SEQ ID NO: 12738 - DNA, 6054 bp, Homo sapiens
ccttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcagttcccacctatgagtgagaatatgcggtgtttggtttttttgatcttgcgatagtttactgagaatgatgatttccaatttcatccatgtccctacaaaggacatgaactcatcattttttatggctgcatagtattccatggtgtatatgtgccgcattttcttaatccagtctatcattgttggacatttgggttggttccaagtctttgctattgtgaataatgccacaataacgtgtgcatatgtctttatagcagcatgatttatagtcctttgggtatatacccagtaatgggatggctgggtcaaatggtatttccaggtctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttcgtttaattagatcccatttgccaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggtgatgcagtctctttttcagttccgtatgaactttaaagtagttttttccaattctgtgaagaaagtcattggtagcttgatggggatggcattgaatctgtaaatcaccttgggcagtatggccattttcacaatattgattcttcctacccatgagcatggaatgttcttccatttgtttgtatcctctttgatttccttgagcagtggtttgtagttctccttgaagaggtccttcacatcctttgtaagttggattcctaggtattttattctctttgaagcaattgtgaatgggagttcactcatgatttggctctctgtttgtctgttgttggtgtttaagaatgctggtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaatttaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagcttttggatgtgctgctggatttgttttgccagtattttattgaggatttttgcatcaatgttcatcaaggatattggtctaaaattctcttcttttgttgtgtctctgcctggctttggtatcagaatgatgctggcctcataaaatgagttagggagaattccctctttttctattgattggaatagtttcagaaggaatggtaccagttcctccttgtatctctggtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcatttaggagcaggttgttcagtttccatgtagttgagcggttttgagtgagattcttaatcctgagttctagtttgattgcactgtggtctgagagatagtttgttataatttctgttcttttacatttgctgaggagagctttacttgcaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgctgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagcggctggtaccggttgttcctttccatgtttagtgcttccttcaggagctcttgtatggcaggcctggtggtgacaaaatctctcagcatttgcttgtctgtaaagtattttatttctccctcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcatttgaactttggtgaatctgacaattatgtgtcttggagttgctcttctcgaggagtatctttttggcgttctctatatttcctgaatctgaacgttggcctgccttgctagattggagaagttctcctggataatatcctgcagagtgttttccaacttggttccattctccccatcactttcaggtacaccaatcagacgtagatttggtcttttcacatagtcccatatatcttggaggctttgctcatttctttttattcttttttctctaaacttcccttctcgcttcatttcattcatttcatcttccattgctgataccctttcttccagttgatcgcatcggctcctgaggcttctgcattcttcacttagttcttgagccttggttttcagctccatcagctcctttaagcacttctctgtattggttattctagttatacattcgtctaaatttttttcaaagttttcaacttctttgcctttggtttgaatgtcctcccatagctcagagtaatttgatcgtctgaagccttcttctctcagctcatcaaagtcattctccatccagctttgttccattgctggtgaggaactgcgttcctttggaggaggagaggtgctctgctttttatagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagagacccacttgaggaggcagtctgcccgttctcagatctccagctgcgtgctgggagaaccactgctctcttcaaagctgtcagacagggacatttaagtctgcagaggttactgctgcctttttctttgtctgtgccctgcccccagaggtggagcctacagaggcaggcaggcctccttgagctgtggtgggctccacccagttcgcgcttccaggctgctttgtttacctaatcaagcctgggcaatggcgggcgcccctcccccagcctcgctgccgcccctcccccagcctcgctgccgccttgcagtttgatctcagactgctgtgctagcaatcagcgagactccgtgggcgtaggaccctctgagccaggtgcgggatataatctcgtggtgcgccgttttttaagcccgtcggaaaagtgcagtattctggtgggagtgacccgattttccaggtgccgtccgtcacccctttctttgactcagaaagggaactccctgaccccttgcgcttcccaggtgaggcaatgcctcgccctgcttcggctcgcacacggtgcacgcacccactgacctgtgcccactgtctggcactccctagtgagatgaacccggtacctcatatggaaatgcagaaatcacccgtcttctgcgttgctcacgctgggagctgtagaccagagctgttcctattcggccatcttggctcctcccccata

SEQ ID NO: 12739 - DNA, 4975 bp, Homo sapiens
tttttgagacagtcttgctctgtcactcagaatggagtgcagtggtgtgaacatggctcactgtggcctccatctcctgggctcaaataatctcctgccttagcctccccagtagctgggaccacatgtttactttttaaaaattttttatttattattattatactttaagttctagggtacatgtgcacaatgtgccagtttgttacatatgtatacatgtgccacgttggtgtgctgcacccattaactcatcatttacattaggtatatctcctaatgctatccctcccccatgcccccaccctacaacaggccccggtgtgtgatgttcctcttcctgtgtccatgtgttctcattgttcacctcccatctatgagtgagaacatgcggtgtttggttttctgtccttgcgatagtttgctgagaatgatggtttccagcttcatccatgtccctacaaaggacatgaactcatcattttttatggctgcatagtattccatggtgtatatgtgccacattttcttaatccagtctatcactgatagacatttgggatggttccaagtctttgctattgtgaatagtgccacaataaacatacgtgtgcatgtgtctttatagcagcatgatttataatccttcgggtatatacctagtaatgggatggctgggtcaaatggtatttctagttctagatccttgaggaatcgccactgtcttccacaatggttgaactagtttaccgtcccaccaacagtgtaaaagtgttcctatttctccacatcctctccagcacctgttgtttcctgactttttaatgatcaccattttaactggtgtgagatggtatctcattgtggttttgatttgcatttctctgatggccagtgatgatgagcattttttcatgtgtctgttggctgcataaatgtcttcttttgagaaatgtctgttcatatcctttgcccacttttcgatggggttgtttgattttttcttgtaaatttgtttaagttctttgtagattctggatattagccctttgtcagatggatagattgcaaaaattttctcccattctgtgggttgcctgttcactctgatggtaatttcttttgctgtgcagaagctctttggtttaattagatcccatttgtcaattttggcttttgttgccattgcttttggtgttttagacaggaagtccttgcccatgcctatgtcctgaatggtattgcctaggttttcttctagggtttttaatggttttcggtctgacattaagtctttaatccatcttgaattaatttttgtataaggtgtaaggaaggggtacagtttcagctttctatatatggctggccagttttcccagcaccatttattaaatagggaatcctttccctatttcttgtttttgtcaggtttgtcaaaggtcagatggttgtaggtgtgtggcattatttctgagggctctgttctgttccattggtctatatttctgttttggtaccagtaccatgctgttttggttactgtagctttgtagtatagtttgaagtcaggtagcgtgatgcctccagctttgttcttttggcttaggattgtcttggcaatgcgggttcttttttggttccatatgaactttaaagtagttttttccaattctgtgaagaaagtcattggtagcttgatggggatggcattgaatctataaattacctcgggcagtatggctattttcacgatattgattcttcctatccatgagcatggaatgttcttccatttgtttgtgtccccttttatttcattgagcagtggtttgtaattctccttgaagaggtccttcacatcccttgtaagttgtattcctaggttttttattttctttgaagcaactgtgaatgggagttcactcatgatttggctctctgtttctctgttattgctgtataggaatgcttgtgatttttgcacattgatattgtatcctgagactttgctgaagttgcttatcagcttaaggagatttttggctgagacgatggggttttctaaatatacagtcatgttatctacaaacagggacaatttgacttcctcttttcctaattgaataccctttatttctttctcctgcctgattgccctggccagaacttccaacactatgttgaataggagcagtgagagagggcattcctctcttgggccagttttcaaagggaatacttacagtttttgcccattcagtatgatattggctgtgggtttgtcataaatagctcttattattttgagatacatcccatcagtacctaatttattgagagtttttagcatgaagcgctgttgaattttctcgaaggccttttctgcatctactgagataatcatgtggtttttgtctttggttctgtttatacgatggattatgtttattgattggcatgttgaaccatccttgcatcccagggatgaagcccacttgatcatggtggataagctttttgatgtgctgctggattcactttgccattattttgttgaggatttttgcatttatgttcatcagggatattgatctaaaattctctttttttgttgtgtctctgccaggctttggtatcaggatgatgctggcctcataaaatgagttagggaggattccctctttttctattgattggaatagtttcagaaggaatggtgccagctcctctttgtacctctggtagaattcggctgtgaatctgtctggtcctggactttttttggttggtagtctcttaattgttgcctcaatttcagagtctgttattggtctattcagggattcaccttcttcctggtttagtcttgggagggtgtatgtgtccaggaatttatccatttcttctagattttctagtttatttgcgtagagttgttcatagtattctctgatggtaatttgtatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggttttttgtgtctctatctccttcagttctgctctgatcttagttatttcttgccttctgctagcttttgcatgtgtttgctcttgcttctctagttcttttaattgtgatgttagggtgtcaattttagatcttttcctgctttctcttgtgggcatttagtgctataaatttccttctacacactgctttaaatgtgtcccagagattctggtatgttgtgtctttattctcattggtttcagagaacacctttgtttctgccttcatttcattttgtacccagtagtcattcaggagcaggttgttcagtttctatgtagctgagcagttctgagtgagtttcttaatcctgagttctagtttgattgcactgtggtctgagagacagttttttataatttctgttctttttcatttgctgaggagtactttacttccgactatgtggtcaattttggaataagtgtgatgtggtgctgagaagaatgtatattctgttgatttggggtggagagttctgtagatgtctattaggtccgcttggtggagagctgagttcaattgctggatatccttgttaactttctgtctcgtggatctgtctaatgttgacagtggggtattaaagtctcccattattattgtgtgggagtctaagtctctttgtaggtctctaaggatttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcttgtttttgttttccatttgcttggtagatcctcctccatccctttattttgagcctatgtgtgtctctgcatgtgagatgggtctcctgaatacagcatactgatgggtctcgactctttatccaatttgccagtctgtgtcttttaattggagcatttagcccatttacatttaaggttaatattgttatgtgtgaatttgatcctgtcattatgatgttagctggttagtttgctcgttagttgatgcagtttcttcctagcctcgatggtctttacagttgggcatgttttttgcagtggctggtaccggttgttccaatccatgtttagtgcttccttcaggagcccttttagggcaggcctggtggtgacaaaatctttcagcatttgctcgtctgtaaagtattttatttgtccttcacttatgaagcttagtttgtctggatatgaaattctgggttgaaaattcttttctttaagaatgttgaatattggcccccactctcttctggcttgtagagtttctgctgagagatctgctgttagtctgatggacttccctttgtgggtaacccgacctttctctctgtctacccttaacattttttccttcatttcaactttggtgaatctaacaattatgtgtcttggagttgctcttcttgaggagcatctttgtggcgttctctgtatttcctgtatttgaatgttggcctgccttgctaggttggggaagttctcttggataatatcctgaagagtgtttccaacttgtttccattctctccgtcactttcaggtacagcaatcagatgtagatttggtcttttcacatagtcccatatgttttggaggatttgttcttttctttttactcttttttctctaaacttctcttcttgcttcatttcattcatttgatcttcaatcactgataccctttcttccagttgatcaaatcagctactgaagcttgtgcatgcatcacgtaattct

SEQ ID NO: 12740 - DNA, 6429 bp, Homo sapiens
tttctttttttttttttgcttttctttctttttttttttttgcttttctttttttttattatactttaagttttagggtacatgtgcacattgtgcaggttagttacatatgtatacatgtgccatgctggtgcgctgcacccactaactcgtcatctagctttaggtatatctcccaatgctatccctccccgctccccccaccccaccacagtccccagagtgtgatattccccttcatgtgtccatgtgacctcattgttcgattcccagctatgaacgagaatatgcggtgtttggtttattgttcttgcgatagtttactgagaatgatgatatccaatttcatccatctccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatgataatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggttcgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccacttttcaaagggaatgcttccagtttttgcccattcagtatgatattggctgtgggtctgtcatagacagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggagggttccctctttttctattgattggaatagtttcagaaggaatggtaacagttcctccttgtacctctggtagaattcggctgtgaatccatctggtcctggactctttttggttggtaaactattgattattgccacaatttcagctcctgttattggtctattcagagattcaacttcttcctggtttagtcttgggtgagtgtatgtgtcgaggaacgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgatcttagttatttcttgccttctgctagcttttgaactagctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttccttatgtacccagtagtcattcaggagcaggttgttcagtttccatgtagttgagcggctttgagtgagattcttaaccctgagttctagtttgattgcactgtggtctgagggatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtacagagctgagttcaattcctgggtatccttgttgactttctgtctcgttgatctgtctaatgttgacagtggggtgttaaagtctctcattattaatgtgtgggagtctaagtctctttggaggtcactcaggacttgctttatgaatctgggtgctcctgtattgggtgcatatatatttaggatagttagctcctcttgttgaattgatccctttaccattatgtaatggccttctttgtctcttttgatctttgttggtttgaagtctgttttatcagagactaggattgcaacccctgcctttttttgttttccatttgcttggtagatcttccttcatccttttattttgagcctatgtgtgtctccgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatttctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtgtgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattctttttctctaaccttcccttctcacttcatttcattcatttcatcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtcttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtccgacagggacatttaagtctgcagaggtttctgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagcaatcagcgagattctgtggggtaggaccctccaagccaggtgagggatataatctcgtggtgcgccgttttttaagccggtctgaaaagcgcaatattcaggtgggagtgacccgattttccaggtgcgtccgtcacccctttctttgacttggaaagggaactccctgaccccttgcgcttcccaggtgaggcaatgcctcgccctgcttcggctcgcgcccggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcctctggtatgtctttatagcagtatgagaatggactaatacagaaaattggtaccagagtagagtggcatttctataaagatacctgaactgtgaaagtgattttggatctgaataatgggcagaggttgggacagtttggagggatgagaggcagacagaaagatgagggaaagtttgaaacttcctagaggctgagtgtggtggctcatgcctgtaatcccagtactttgggaggccaagggggatggatcccttgaggtcagtagttcaagaccagcctggtcaacatggcaaaaccccgtctctactaaaaacatggaaattagctgggcctggtgacgcatgccttaatcctcgct

SEQ ID NO: 12741 - DNA, 4975 bp, Homo sapiens
tttttgagacagtcttgctctgtcactcagaatggagtgcagtggtgtgaacatggctcactgtggcctccatctcctgggctcaaataatctcctgccttagcctccccagtagctgggaccacatgtttactttttaaaaattttttatttattattattatacttaaagttctagggtacatgtgcacaatgtgccagtttgttacatatgtatacatgtgccacgttggtgtgctgcacccattaactcatcatttacattaggtatatctcctaatgctatccctcccccatgcccccaccctacaacaggccccggtgtgtgatgttcctcttcctgtgtccatgtgttctcattgttcacctcccatctatgagtgagaacatgcggtgtttggttttctgtccttgcgatagtttgctgagaatgatggtttccagcttcatccatgtccctacaaaggacatgaactcatcattttttatggctgcatagtattccatggtgtatatgtgccacattttcttaatccagtctatcactgatagacatttgggatggttccaagtctttgctattgtgaatagtgccacaataaacatacgtgtgcatgtgtctttatagcagcatgatttataatccttcgggtatatacctagtaatgggatggctgggtcaaatggtatttctagttctagatccttgaggaatcgccactgtcttccacaatggttgaactagtttaccgtcccaccaacagtgtaaaagtgttcctatttctccacatcctctccagcacctgttgtttcctgactttttaatgatcaccattttaactggtgtgagatggtatctcattgtggttttgatttgcatttctctgatggccagtgatgatgagcattttttcatgtgtctgttggctgcataaatgtcttcttttgagaaatgtctgttcatatcctttgcccacttttcgatggggttgtttgattttttcttgtaaatttgtttaagttctttgtagattctggatattagccctttgtcagatggatagattgcaaaaattttctcccattctgtgggttgcctgttcactctgatggtaatttcttttgctgtgcagaagctctttggtttaattagatcccatttgtcaattttggcttttgttgccattgcttttggtgttttagacaggaagtccttgcccatgcctatgtcctgaatggtattgcctaggttttcttctagggtttttaatggttttcggtctgacattaagtctttaatccatcttgaattaatttttgtataaggtgtaaggaaggggtacagtttcagctttctatatatggctggccagttttcccagcaccatttattaaatagggaatcctttccctatttcttgtttttgtcaggtttgtcaaaggtcagatggttgtaggtgtgtggcattatttctgagggctctgttctgttccattggtctatatttctgttttggtaccagtaccatgctgttttggttactgtagctttgtagtatagtttgaagtcaggtagcgtgatgcctccagctttgttcttttggcttaggattgtcttggcaatgcgggttcttttttggttccatatgaactttaaagtagttttttccaattctgtgaagaaagtcattggtagcttgatggggatggcattgaatctataaattacctcgggcagtatggctattttcacgatattgattcttcctatccatgagcatggaatgttcttccatttgtttgtgtccccttttatttcattgagcagtggtttgtaattctccttgaagaggtccttcacatcccttgtaagttgtattcctaggttttttattttctttgaagcaactgtgaatgggagttcactcatgatttggctctctgtttctctgttattgctgtataggaatgcttgtgatttttgcacattgatattgtatcctgagactttgctgaagttgcttatcagcttaaggagatttttggctgagacgatggggttttctaaatatacagtcatgttatctacaaacagggacaatttgacttcctcttttcctaattgaataccctttatttctttctcctgcctgattgccctggccagaacttccaacactatgttgaataggagcagtgagagagggcattcctctcttgggccagttttcaaagggaatacttacagtttttgcccattcagtatgatattggctgtgggtttgtcataaatagctcttattattttgagatacatcccatcagtacctaatttattgagagtttttagcatgaagcgctgttgaattttctcgaaggccttttctgcatctactgagataatcatgtggtttttgtctttggttctgtttatacgatggattatgtttattgattggcatgttgaaccatccttgcatcccagggatgaagcccacttgatcatggtggataagctttttgatgtgctgctggattcactttgccattattttgttgaggatttttgcatttatgttcatcagggatattgatctaaaattctctttttttgttgtgtctctgccaggctttggtatcaggatgatgctggcctcataaaatgagttagggaggattccctctttttctattgattggaatagtttcagaaggaatggtgccagctcctctttgtacctctggtagaattcggctgtgaatctgtctggtcctggactttttttggttggtagtctcttaattgttgcctcaatttcagagtctgttattggtctattcagggattcaccttcttcctggtttagtcttgggagggtgtatgtgtccaggaatttatccatttcttctagattttctagtttatttgcgtagagttgttcatagtattctctgatggtaatttgtatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggttttttgtgtctctatctccttcagttctgctctgatcttagttatttcttgccttctgctagcttttgcatgtgtttgctcttgcttctctagttcttttaattgtgatgttagggtgtcaattttagatcttttcctgctttctcttgtgggcatttagtgctataaatttccttctacacactgctttaaatgtgtcccagagattctggtatgttgtgtctttattctcattggtttcagagaacacctttgtttctgccttcatttcattttgtacccagtagtcattcaggagcaggttgttcagtttctatgtagctgagcagttctgagtgagtttcttaatcctgagttctagtttgattgcactgtggtctgagagacagttttttataatttctgttctttttcatttgctgaggagtactttacttccgactatgtggtcaattttggaataagtgtgatgtggtgctgagaagaatgtatattctgttgatttggggtggagagttctgtagatgtctattaggtccgcttggtggagagctgagttcaattgctggatatccttgttaactttctgtctcgtggatctgtctaatgttgacagtggggtattaaagtctcccattattattgtgtgggagtctaactctctttgtaagtctctaaagatttgctttatgaatctgggtgctcctgtcttgggtgcatatatatttaagatagttagctcttcttgttgaattgatccctttaccattatgtaatggccttctttgtctcttctgatctttgttggtttaaagtctgttttatcagagactaggattgcaacccctgcttgtttttgttttccatttgcttggtagatcctcctccatccctttattttgagcctatgtgtgtctctgcatgtgagatgggtctcctgaatacagcatactgatgggtctcgactctttatccaatttgccagtctgtgtcttttaattggagcatttagcccatttacatttaaggttaatattgttatgtgtgaatttgatcctgtcattatgatgttagctggttagtttgctcgttagttgatgcagtttcttcctagcctcgatggtctttacagttgggcatgttttttgcagtggctggtaccggttgttccaatccatgtttagtgcttccttcaggagcccttttagggcaggcctggtggtgacaaaatctttcagcatttgctcgtctgtaaagtattttatttgtccttcacttatgaagcttagtttgtctggatatgaaattctgggttgaaaattcttttctttaagaatgttgaatattggcccccactctcttctggcttgtagagtttctgctgagagatctgctgttagtctgatggacttccctttgtgggtaacccgacctttctctctgtctacccttaacattttttccttcatttcaactttggtgaatctaacaattatgtgtcttggagttgctcttcttgaggagtatctttgtggcgttctctgtatttcctgtatttgaatgttggcctgccttgctaggttggggaagttctcttggataatatcctgaagagtgtttccaacttgtttccattctctccgtcactttcaggtacagcaatcagatgtagatttggtcttttcacatagtcccatatgttttggaggatttgttcttttctttttactcttttttctctaaacttctcttcttgcttcatttcattcatttgatcttcaatcactgataccctttcttccagttgatcaaatcagctactgaagcttgtgcatgcatcacgtaattct

SEQ ID NO: 12742 - DNA, 6032 bp, Homo sapiens
aaggtatttttttttttttattatactttaagttttagggtacatgtgcacattgtgcaggttagttacatatgtatacatgtgccatgctggtgcgctgcacccactaacttgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacggtcccaccaacagtgtaaaagtgttcctatttctccacatcctctccagcacctgttgtttcctgactttttaatgattgccattctaactggtgtgagatgatatctcatagtggttttgatttgcatttctctgatgaccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcaaaaattttctcccatgttgtaggttgcctgttcactctgatcgtagtttcttttgctgtgcagaagctctttagtttaattagatcccatttgtcaattttggcttttgttgccattgcttttggtgttttggacatgaagtccttgcccacgcctatgtcccgaatggtaatgcctaggttttcttctagggttatatggttttaggtctaacgcttaaatatttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctaagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcctttttggttgtgtctctgcccggctttggtatcagaatgatgctggcctcataaaatgagttagggaggattccctctttttctatcgattggagtagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagaatgtatgtgtcgaggaatgtatccatttcttctagattttctagtttatttgagtagaggtgtttgtagtattctctgatggtagtttgtatttctgtgggatcggtggtgatatcccctttatcattttttattgcgtctatttgattcttctctcttttttttttttattagtcttgctagcgatctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgtgggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtagtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcacatgagatgggtttcctgaatacagcacactgatgggtcttgactctttatccaacttgccagtctgtgtcttttaattggagaatttattccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctaggttggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagtttcaacttctttgtttttggtttgaatgtcctcccgtagctcagagtaatttgatcatctgaagccttcttctcttagctcgtcaaaatcattctccatccagctttgttccgttgctggtgaggaactgcgttcctttggaggagaggcgctctgcgttttagagtttccagtttttctgttctgttttttccccatctttgtggttttatctacttttggtctttgatgatggtgatgtacagatgggttttcggtgtggatgtcctttctgtttgttatttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgccgccttgcagtttgatctcagactgctgtgctggcaatcagtgagattccgtgggcgtaggaccctccgagccaggtgtgggatatagtctcgtggtgcgccattttttaagccggtctgaaaagtgcaatattcgggtgggagtgacccgattttccaggtgcgtctgtcacccctttctttgactcggaaagggaactccctgaccccttgcgcttcccaggtgaggcaatgcctcgccctgcttcggctcgcgcacggtgcgtgcacccactgacctgcgcccactgtctggcactccctagtgagatgaacccggtacctcagatggaaatgcagaaatcaccagtcttctgcgtcgctcacgctgggagctgtagaccggagctgttcctattcggccatcttggctcctccc

SEQ ID NO: 12743 - DNA, 6532 bp, Homo sapiens
ttatttttttattttttattttttcttgagttttttttaatttatttatttattattattataccttaagttttagggtacatgtgcacaatgtgcaggttagttacatatgtatacatgtgccatgctggtgcgctgcacccactgactcgtcatctagcattagttatatctcccaatgctatccctcccccctccccccaacccacaacaatccccagaatgtgatgttccccttcctgtgtccatgtgttctcattgttcaattcccacctatgagtgagaatatgcggtgtttggttttttgttcttgcgatagtttacggagaatgatgatttccaatttcatccatgtccctacaaaggacatgaacccatccttttttatggctgcatagtattccatggtgtatatgtgccacattttcttaatccagtctatcattgttggacatttgggttggttccaagtctttgctattgtgaataatgccgcaataaacatgtgtgcatatgtctttatagcagcatgatttatagtcctttagggtatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgttgtttcctgacttcttaatgattgccattctaactggtgtgagatggtatctcattgtggttttgatttgcatttctctgatggccagtgatggtgagcattttttcatgtgttctttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgcccatgcctatgtcctgaatggtaatgcctaggttttcttctagggtttttatggttttaggttgaacgtttaagtctttaatccatgttgaattgatttttgtataaggtgtaaggaagggatccagtttcagctttctacatatggctagccagttttcccagcaccatttattaaatagggaatcctttccccactgcttgtttttctcaggtttgtcaaagatcagatagttgtagataggcggcgttatttctgagggctctgttctgttccatgaatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatgtgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagtcagattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgcccattttcaaagggaatgcttccagtttttgcccattcagtatgatattggctgtgggtttgtcatagatagctcttattattttgaaatacgtcccatcaatacctaatttattgagagtttttagcatgacgggttgttgaattttgtcaaaggccttttctgcatctattgagataatcatgtggtttttgtctttggttctgtttatatgctggattacatgtattgatttgcatatattgaaccagccttgcgtcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatcgtaccagttcctccttgtacctctggtagaattcggctgtgaatctatctggtcctggactctttttggttggtaagctattgattattgccacaatttcagatcctgttattggtctattcagagattcaacttcttccttgtttagtctttggagggtgtatgtgtcaaggaatttatccatttcttctagattttctagtttgtttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaatttttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtgggcatttagtgctataaatttccctctatacactgctttgaatgcgtcccagagattttggtatgttgtgtctttgttctcgttggtttcaaagaacatctttatttctgccttcattttgttatgtacccagtagtcattcaggagcaggttgttcggtttccatgtagttgagtggttttgagtgagattcttaatcctgagttctagtttgattgtactgtggtctgagagatagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgccttgttttgttttccatttgcttagtagattttcctccatccctttattttgagcctatgtgtgtctctgcacgtgagatgggtttcccgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcgttagttgatgcagtttcttcctagcttggatggtctttatattttggcatgattctgcagcggctggtaccggttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctgggtcgaaaattcttttctttaagaatgttgaatattggcccccactctcttctggcttgtagagtttctgccaagagatccgctgttagtctgatgggcttccctttgagggtaacccgacctttctctctggctgcccttaacattttttccttcatttcaactttggtgaatctgacaattatgtgtcttggaattgctcttctcgaggagaatctttgtggcattctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttgtttgtttctttttattcttttttctctaaacttcccttcttgcttcatttcattcatttcatatttcatcgctgataccctttcttccagttgatcgcatcggctcctgaggcttctgcattcttcacgtagttcttgagccttggttttcagctccatcagctcctttaagcacttctctgtattggttattctagttatacattcttctaaatttttttcaaagttttcaacttctttgcctttggtttgaatgtcctcccatagctcggagtagtttgatcgtctgaagccttcttctctcagctcgtcaaagtcattctccctccagctttgttccgttgctggtgaggagctgcgttcctttggaggaggagaggcgctgcgttcctttggaggaggagaggcgctctgctttttagagtttccagtttttctgctctgttttttccccatctttgtggtttttatctacttttggtctttgatgatggtgatgtacagatgggtttttggtgtggatgtcctttctgtttgttagttttccttctaacagacaggaccttcagctgcaggtctgttggagtacccggccgtgtgaggtgtcagtctgcctctgctagggagtgcctcccagttaggctgctcgggggtcagggtcagggacccacttgaggaggcagtctgccagttctcagatctccagctgcgtgctgggggaaccactgctcttttcaaagctgtcagacagggacacttaagtctgcagaggttactgctgtctttttgtgtgtctgtgccctgcccccagaggtggagcctacagaggcaggcaggcttccttgagctgtggtgggctccacccagttggagcttcctggctgctttgttaacctaagcaaagcctgggcaatggcgggcgcccctcccccagcctcgctgccgccttgtagtttgatctcagactgctgtgctagcaatcagcgagactccgtgggcgtgggaccctccgagccaggtgcgggatataatctcgtggtgcgcctttttttaagcccgtcggaaaagcgcagtattcgggtgggagtgacccgatcttccatgtgccgtctgtcacccctttctttgactaggaaagggaactccctgaccccctgcgcttcccaagtgaggcaatgccttgccctgcttcggctcgcggatggtgcacgcacccactgacctgcgcccactgtctggcactccctagtgagatgaacccggtacctcagatggaaatggagaaatcgcctgtcttctgcgtctctcacgctgggagctgtagaccggagctgttcctatttggccatcttggctcctctctcctctcttcactttaataatggattagttttctgccttctcctgtggggaatctttttggtaagggagggaagaaagattagttattcttgtgcatcagtatctttttctttttttattgtagtaagaacatctaacatgagatctaccctcttaacaattttttaagtgtacaatacagtattgctaactataggcatgaggatgtgcagcagatctctggaacgtttcactctttataactgaagctttataccccttgaatagcagcttcccatttccctgtcttcatagcccctggcatccaccattctacactctttctgtggggttgactattttaattacctgacgcaactggaatcatacattatttgtctttctgtgactggtttatttcacgtagcataaagtcaccaaggttcatc

SEQ ID NO: 12744 - DNA, 6153 bp, Homo sapiens
tttttttttcttttttttttttttttattatactctaagttttagggtacatgtgcacattgtgcaggttagttacatatgtatacatgtgccatgctggtgcgctgcatccactaatgtgtctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccattttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatctgggtatatacccagtaatgggatggctgggtcaaatggtatttctagttctagatccctgaggaatcgccacactgacttccacaatggatgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcgaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtaagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgagtttagttgtttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttttcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctgttaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcaatttcttcctagcctcgacggtctttacaatttggcatgattttgctgtggctggtaccggttgctcccttccatgtttagtgcctccttcaggagctcttttagggcaggcctggtggtgacaaaatctctcagcatttgcttctctgtaaaggattttatttctccttcacttatgaagcttagtttggttggatatgaaattctgggttgaaaactcttttctataagaatgttgaatattggcccccactctcttctggcttgtagagtttctgctgagagatccactgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttgtttccattctccccatcactttcaggtacaccaatcagacgtagatttggtcttttcacataatcccatatttcttgtaggctttgttcatttctttttattcttttttctctaaacttcccttctcgcttcatttcattcatttcagcttccatcactgataccctttcttccagttgatcgcgtcggctcctgaggcttctgcattcttcacgtagttctcgagccttggctttcagctccatcagctcctttaagcacttctctgtattggttattctcgttatacattggtctaaatttttttcaaagtttttaacttctttgcctttggtttgaatttcctcctgtagctcagagtagtttgatcatctgaagccttcttctctcaacttgtcaaagtcattctccatccagctgtgttccgttgctggtgaggagttgcattcctttggaggaggagaggcactctgctttttagagtttccagtttttctgctctgttttttccccatctttgtggtttttatctacttttggtctttgatgatggtgatgtacagatgggtttttggtgtggatgtcctttctgtttgttagttttccttctaacacacaggaccctcagctgcagctctgttggagtttgctagaggtccactccagaccctggttgcctgggtaacagcagcggtggctgcagaacagcggattttcatgaaccgcgaatgctgctgtctgatcgttcctctggaagttttgtctcagaggagtacccagccgtgtgaggtgtcagtctgcccctactggggggtccctcccagttacactgctcgggggtcaggggtcagggacccacttgaggaggcagtctgcccattctcagatctccagctgtgtgctgggagaaccactgctttcttcaaagctgtcagacagggacatttaagtctgaggaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcggccgccccttccccagcctcgctgccaccttgcagtttgatctcagactgctgtgccagcaatcagtgagactctgtgggcgtaggaccctccgagccatgtgcgggatataatctcctggtgtgccgttttttaagcccgttggaaaagcacagtattcgggtgggagtgacccgattttccaggtgccgtctgtcacccctttctttgactaggaaagggaactccctgaccccttgtgcttcccaagtgaggcaatgcctcaccctgcttcggcttgtgcacggtgtgctgcacccactgtcccgcgcccactgtctggcactcccttgtgagatgaacacggtacctcagatggaaatgcagaaatcacccgtcttctgcgtcgctcatgctgggagctatggaccggagctgttcctattcggccatcttgactgccc

SEQ ID NO: 12745 - DNA, 5868 bp, Homo sapiens
actgtttttttttattatactttaagttttagggtacatgtgcacattgtgccagttagttacatatgtatacatgtgccacgttggtgtgctgcacccattaactcatcatttagcattaggcatatctcctaatgctatccctcccccctccccccaccccacaacagtccccagagtgtgattttccccttcctgtgtccatgtgttctcattgttcaattcccatctatgagtgagaacatgcggtgcttggttttttgtccttgtgatagtttactgagaatgatgatttccagtttcatccatgcccctacaaaggacatgaacacatcattttttatggctgcatagtattccatggtgtatatgtgccacattttcttaatctagtctatcattgttggacatttgggttggttccaagtctttgctattgtgaatagtgccgcaataaacatatgtatgcatgtgtctttatagcagcatgatttatagtcctttgggtatatacccagtaatgggatggctgggtcaaatggtatttctagttctagatccctgaggaatcgccacactgtcttccacaggggttgaactagtttacagtcccaccgtgtaaaagtgttcctatttctccacatcctctccagcacttgttgtttcctgactttttaatgattgccattctaactggtgtgagatggtatctcattgtggttttgatttgcatttctctgatggctagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgctgaagctctttagtttaattagataccacttgtcaattttagcttttgttgccattgcttttggtgttttagacatgaagtccttgcccatgcctatgtcctgaagtaatgcctaggttttcttctagggtttttatggttttaggtctaacgtttaagtctttaatccaccttgaattaatttttgtataaggtgtaaggaaaggatccagtttcagctttctacatatggctagccagttttcccagcaccatttattaaatagggaatcctttccccattgcttgtttttctcaggtttgtcaaagatcagatagttgtagatatgtggcgttatttctgagtgctctgttctgttccattggtctatatctctgttttggttcccatgctgttttggttactgtagccttgcagtatagtttgaagtcaggtagtgtgatgcctccagctttgttcttttggcttaggattgacttactgatgcgggctcttttttggttccatatgaactttaaagtagttttttccaattctctgaagaaagtcattggtagcttgatggggatggcattgaatctataaattaccttgggcagtatggccattttcacgatattgattcttcctacccatgagcatagaatgttcttccatttgtttgtatcctcttttatttcattgagcagtggtttgtagttctccttgaagaggtccttcttgtcccttgtaagttggattcataagtattttattctctttgaagcaactgtgaatgggagttgactcacgatttggctctctgtttgtctgttattggtgtataagaatgcttgtgatttttgtacattgattttgtatcctgagactttgcagaagttgcctatcagcttaaggagattttgggctgagacaatggggttttctagatatacaatcatgtcatctgcaaacagggacaatttgacttcctcttttcctaaccgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttatttattggtgtatattgaaccagccttgcatcccagggatgaagcccacttgatcatggtggataagctttttgatgtgctgctggattcactttgccagtattttattgaggatttttgcatcaatgttcatcaaggatatcggtctaaaattctcttttttggttgtgtctctgcccggctttggtatcaggatgatgctggcctcataaaatgagttagggaggattctctctttttctattgattggaatagtttcagaaggaatggtaccagttcctccttgtacctctggtagaattcggctgtgaatccatctggtcctggactctttttggttggtgagctagtgattattgccacaatttcagagcctgttattggtctattcagagattcaacttcttcctggtttagtcttgggagggtgtatgtgtccaggaatttatccatttcttctaccttttctagtttatttgcgtagaggtgtttgtagtatcctctgatggtagtttgtatttctgtgggattggtggtgatatcccctttatcattttttattgcatctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttccttttctagttcttttcattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttgtgtacccagtagtcattcaggagcaggttgttcagtttccatgtagttgagtggttttgagtgagtttcttaatcctgagttctagtttgattgcactgtggtctgagagacagtttgttataatttctgatcttttacatttgctgaggagagctttacttccaactatgtggtcaattttggaataggtgtggtgtagtgctgaaaaaaatgtatattctgttgatttggggtggagagttctgtagatgtctattaggtccgcttggtgcagagctgagttcaattcctgggtatccttgttaactttctgtctcgttcatctgtctaatgttgacagtggggtgttaaagtctcccattattattgtgtgggagtctaagtctctttgtaggtcactcaggacttgctttatgaatctgggtgctcctgtattgggtgcatatatatttaggatatttagctcttcttgttgaattgatcccttcaccattatgtaatggccttctttgtctcttttgatctttgttggtttagagtctgttttatcagagactaggattgcaacccctgccttttttgttttccatttgcttgatagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagctaatattgttatgtgtgaactttgatcctgtcattatgatgttagctggttatttattttgctcattagttgatgcagtttcttcctaatcttgatagtctttacattttggcatgattttgcagtggctggtaccagttgtgcctttccatgtttagtgcttccttcaggagctcttttagggcaggcttggtggtgacaaaatctctcagcatttgcttgtctgtaaaggattttatttctccacttatgaagcttagtttggctggatatgaaattctgggttgaaaattcttttctttaagaatgttgaatattggcccccactctcttctggcttgtagagtttctgccaagagatccgctgtcagtctgatgggcttccctttgtgggtaacctggcctttctctctggctgcccttaacattttttccttcatttcaactttggtgaatctgacaatcatgtgtcttggagttgttcttctcaaggagtatctttgtggtgttctctgtatttcctgaatctgaatgttggcctgccttgctagattggggaagttgtcctggataataacctgcagagtgttttccaacttgtttccattctccccgtcactttcaggtacaccaatcagatgcagatttggtcttttcagatagtcccatatttcttggaggctttgttcgtttctttttattcttttttctctaaacttcccttctcgcttcatttcattcatttcatcttccatcactgatatcctttcttccagttgattgcatcggctccagaggcttctgccttcttcacgtagttctcgagccttggctttcagcttcatcagctcctttaagcacttctctgtatcggttattctagttatacattcgtctaaatttttttcaatgttttcaacttctttgcctttggtttgaatttcctcctgtagctcagagtagtttgatcgtctgaagccttcttctctcaactcgtcaaagtcattctccgtccagctttgttccgctgctggtgaggaactgcgttcctttggaggaggagaggcactctgctttttagagtttccagtttttctgctctgttttttccccatctttgtggttttatctactttttgtctttgatgatggtgatgtacagatggggttttggtgtggatgccctttctgttcgttagttttccttctaacagacaggaccctcacctgcaggtctgttggagtttgctagaggtccactccagaccctgtttgcctgggtatcagcagcggtgtctgcagaactgtggattttcgtgatccgcgaatgctgctgtctgatagttcctctggaagttttgtctcagaggagtacctggccgcgtgaggtgttagtctgcccctactggggggtgcctcccagttaggctgcttgggggtcggggtcagagacccacttaaggaggcagtcttcccattctcagatctccagctgcatgctgggagaaccactgctctcctcaaagctgtcagacagggacatttaagtctgcagaggttactgctgtctttttgtttgtctgtgccctgcccccagaggtggagtctacagaggcaggcaggcctccttgagctgtggtgggctccacccagtttgagcttcctggctgcttcgtttacctaagcgagtctgggcaatggcgggtgcccctcccccagccttgctgctgccttgcagtttgatcttagactgctgtgctagcaatgagcgagactccgtgggcgtaggaccctccaagccaggtgcgggatataatctcctggtgtgccatttcctaagcccgtcggaaaagcgcagtattcgggt

SEQ ID NO: 12746 - DNA, 6041 bp, Homo sapiens
tcaattttttttaatttttttattattatactttaagttttagggtacatgtgcacattgtgcaggttagttacatatgtatacatgtgccatgctggtgtgctgcacccactaactcatcatctagcattaggtatatctcccaatgctatccctcccccctccccccacccacaacagtccccagagtgtgatgttccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatcctgaggaatcgccacactgacttccacaatggttgaactagtttacagtcccaacaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcctgtataaatgtcttcttttgagacgtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagagaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgaactttaaagtagttttttccaattctgtgaagaaaggcattggtagcttgatgggggtggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagctggattcctaggtattttattctctttgaagcaattgtgaatgggagttcactcatgatttggctctctgtttttctgttgttggtgtgtaggaatgcttgtgatttttgcacattgattttgtatcctgagactttgctgaagttgcttatgagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaggttgttgaattttgtcaaaggccttttctccatctattgagataatcatgtggtttttgtctgtggctctgtttatatgctggattacatttattgatttgcatatattgaaccagccttgcatcccagggatgaagcccagttgatcatggtggataagctttttgatgtcctgctggatttggtttgccagtattttattgaggatttttgcatcaatgttcatcaaggatattggtctaaaattctcttctttggttgtgtctctgcctggctttggtatcagaatgatgctggcctcataaaatgagttagggaggattccctctttttctattgattggaatagtttcagaagtaatggtaccagttcctccttgtacctgtggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgacggtagtttgtatttctgtgggattggtggtgatatccccttttatcattttttattgcgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaggttagggtgtcaattttggatctttcctgttttctcttgtgggcatttagtgctataaatttccctctacacactgctttgaatgtgtcccagagatgctggtatgttgtgtctttgttctcgttggtttcaaagaacatctttatttctgccttcatttcgttatgtacccagtagtcattcaggagccggttgttcagtttccatgtagttgagcggttttgagtgagattcttaatcctgagttctagtttgattgcactgtggtctgagagatagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccgtttgcttggtaggtcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggtgattttgctcgttacttgatgcagtttcttcctagacttgatgatcgttacattttggcatgattttgcagcggctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttaaatattggcccccactctcttctggcttgtagggtttctgccaagagatccgctgttagtctgatgggcttccctttgagggtaacccgacctttctctctggctgcccttaaaattttttccttcatttcaactttggtgaatctgacaattatgtgtcttggagttgctcttctcgaggaatatctttgtggcgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaattttccttcttgcttcatttcattcatttcatcttccattgctgatactctttcttccagttgatcacatcggctcctgaggcttctgcattcttcgcgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccttccagctttgttccgttgctggtgaggagctgcgttcctttggaggaggagaggtgctctgatttttagagtttccagtttttctgttctgttttttccccatctttgtggttttatctacttttggtctttgatgatggtgatgtacagatgggtttttggtgtggatgtcctttctgtttgttagttttccttcgaacagacaggaccctcagctgcaggtctgttggagtaccctgcagtgtgaggtgtcagtgtgcccctgctggggggtgcctcccagttaggctgctcgggggtcaggggtcagggacccacttgaggaggcagtctgcccgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagctgggcaatggtgggcgcccctcccccagcctcgctgccgccttgcagtttgatctcagactgctgtgctagcaatcagcgagattccatggggtaggaccctccgagccaggtgcaggatataatctcgtggtgcgccgttttttaagcccatcggaaaagcgcagtattcgggtgggaatgacccgattctccaggtgccgtccgtcacccctttctttgattaggaaagggaactccctgaccccttgtgcttcccgagtgaggcaatgcctcgccctgcttcggctcgcgcacggtgcgtgcacccactgacctgcacccactgtctggcactccctagtgagatgaacccagtacctcagatgaaaatgcagaaatcacccgtcttctgcgtcgctcaggctgggagctgtagaccggagctgttcctattcggccatcttggctcctcccaac

SEQ ID NO: 12747 - DNA, 10575 bp, Homo sapiens
tttatttatttatttattattttttatgttatatatatattttttcttttattattatactttaagttttagggtacatgtgcacattgtgcaggttatttacatatgtatacatgtgccacgctggtgcactgcacccactaactggtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtttatcattgttggacatttgcgttggttccaagtctttgctattgtgaatagtgccgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgtttgtgtcctttgcccactttttgatggggttgtttgtttttttcttgtaaattggtttgagttcattgtagattctggatattagccctttgtcagatgagtaggttgcaaaaattttctcccattttgtaggttgcctgttcactctgatggtagtttcttttgctgtacagaagctgtttagtttaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaaggaatccagtttcagctttctacatatggctagccagttttgccagcatcatttattaaatagggaatcctttccccattgcttgtttttctcaggtttgtcaaagatcagatagttgtagatatgcggcattatttctgagggctctgttatgttccattgatctatatctctgttttggtaccagtaccatgctgttttggttactgtagccttgtagtatagtttgaagtcaggtagtgtgatgcctccagctttgttcttttggcttatgattgccttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacaatggggtttgctagatatacaatcgtgtcatctgcaaacagggacaatttgacttcctcttttcctaattgaataccctttatttccttcttctgcctaattgccctggcgagaacttccaacactatgttgaataggagtggtgagagagggcatccctgtcttgtgccagtcttcaaagggaatgcttccagtttttgcccattcagtatgatattggctgtgggtttgtcataaatagctcttattattttgagatacatcccatcaatacctaatttattgagagtttttagcatgaagggttgttgaattttgtcaaaggccttttctgcatctattgagataatcatgtggtttttgtctttggctctgtttatatgctggatcgcatttattgatttgtatatattgaaccagccttgcatcccaggaatgaagcccacttgatcatggtggataagctttttgatgtgctgctggattttttttgcaagtattttattgaggatttttgcaccaatgttcatcaaggatattggtctaaaattctcttttttggttgtgtctctgccaggctttggtatcagaatcatgctggcctcataaaatgagttagggaggattccctctttttctattgattggaatagtttcagaaggaatggtaccagttcctccttgcacctctggtagaattcggctgtgaatccatctggtcctggactctttttggttggtaagctattgattattgccacaatttcagatcctgttattggtctattcagagattcaacttcttcctggtttagtcttgggagagtgtatgtgttgaggaatttatccatttcttctagattttctagtttatttgcgtagaggtgtttgtattattctctgatggtagtttgtatttctgtgggatcggtggtgatatcccctttattatttttttattgcatctatttgattcttctctctttttttctttattattcttgctagtggtctatctattttgttgatcctttcaaaaaaccagctcctggattcattaattttttgaagggttttttgtgtctctctttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctgtaaatttccctctacacactgctttgaatgcgtcccagagattctggtatgttgtgtctttgttctccttggtttcaaagaacatctttatttctggcttcattttgttatgtacccagtagtcattcaggagcaggttgttcagtttccatgtagttgagtggttttgagtgagattgttaatcctgagttctagtttgattgcactgtggtctgagagatagtttgttataatttctgttcttttacatttgctgaggagagctttacttccaagtatgtggtcaattttggaataggtgtggtgtggtgctgaaaaaaaatgtatattctgttgatttggggtggagagttctgtagatgtctattaggtctgcttggtgcagagctgagttcaattcctgggtatccttgttgactttctgtcttgttgagctgtctaatgttgacagtggggtgttaaagtctcccattattaatgtgtgggagtctaagtctctttgtaggtcactcaggagttgctttatgaatctgggtgctcctgtattgggtgcatatatatttaggatagttagctcttcttgttgaattgatccctttaccattatgtaatggccttctttgtctcttttgatctttattggtttaaagtctgttttatcagagactaggattgcaacccctactttttttgttttccatttgcttgatagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggctggtaccggttgttcctttccatgtttagtgcttccttcaggagctgttttagggcaggcctggtggtgacaaaatctctcagcatttgcttgtctgtaaaatattttatttctccctcactgatgaagcttagtttggctggatatgaaattctgggttgaaaattcttttctttaagaatgttgaatattggcccccactctcttctggcttgtagggtttctgttgagagatcagctgttagtctgatgggctcccctttgagggtaacccgacctttctctctggctgcctttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcactttcaggtacaccaatcagacgtagatttgttcttttcacatagtcccatatttcttggaggctttgctcatttctttttattcttttttctctaaacttcccttctcgcttcatttcattcatttcatcttgcatcgctgataccctttcttccagttgatcgcatcggctcctgagccttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagttcatcaaagtcattctccatccagctttgttccattgctggtgaggaactgcattcctttggaggaggagaggcgctctgctttttagagtttccagtttttctgttctgttttttccccgtctttgtggttttatctacttttggtctttgatgacggtgatgtacagatgggtttttggtgtggatgtcctttctgtttgttagttttccttctaacagacaggaccctcagctgcaggtctgttggagtaccctgccatgtgaggtgtcagtgtgccctgctggggggtgcctcccagttaggctgctcaggggtcaggagtcagggacccacttgaggaggcagtctgcccattctcagatctccagctgtgtactgggagaaccacggctctcttcaaagctgtcagagagggacatttaagtctgcagaggttactgctttttgtttgtctgtgctctgcccccagaggtggagcctacagaggcaggcaggcctccttgagctgtggtgggctccacccagttcgagcttcctggctgctttgtttacctaagcaagcctgggcaatggcgggcacccctcccccagcctcgctgccaccttgcagtttgatctcagacggttgtgctagcgatcagcgagactccatgggcgtacgaccctcccagccaggtgtgggatataatctcatggtgcgccgtttttttaagcccgtcagaaaagcacagtattcgggtgggagtgacccgattttctaggtgctgtctgtcacccctttctttgactaggaaagggaactccctgaccccttgcgcttcccgagtgaggcaatgcctcaccctgcttcggcttgtgcacggttcgtgcacccactgacctgcgcccactgtctggcactccctagtgagatgaacccagtacctcagatggaaaagcagaaatcacccgtcttctgcatcgctcacgctgggagctgtagaccagagctgttcctattccattttcaatctattgattgtgtcttcagatacataacagcttgtcactttgatgaagttctttttatgtatttttggtgttgttgttgtctgtgctttcactgtcatatccaagaaattattgccagattctatgttatgaaacatttttcctatgtttcttctaagggttttatagttttagctcttacaattagatgtttagtccattttaaattaagttttttatatggtgtaaaataaggctccaactgtattgttttccatgtaaatattcattcttaacaccgtttaaaaatatactgtcctttccccatagttttgactcccttgttaaaaatcatgactgtgttttttggttctttatttctattgcattggtctttatgtctgtctctatggtggtacagcattgttttgggtactgaagcattgcagtaagtttgaaaccaggaggtgttagtcctctaattttgttagtttttaagattgatttggctacttggggttttttgagatttcatctgaattttagaataggtttttgtatttttgcaaatattggaatctttatagtgattttattgaatctgtagatgactattgataacaatggaatcttgatgaggttttgtcttccagtccataaacacatgatgtcttttcatttatttgtgttatctttaatactttcctgcaatgtttatacttttgctgtacaggtttctcatttccttggttaaattggtttctaagtattttattcttttgatgctatcataaatgatactgttgtcttgatttcttcttcagatggtttgttattgtagaaatacgaccgatttttgtgtgttgattttgtatcctgcagttttgctgaatgttatttattgcatctgatagtttatctcacagaaactaaaagatttttaatatacaaggttatgtcatctgcgaacagaaaattttacttttttaaaaattggaatatgttttattgttttacttgccttattgttttaactaactagaaccttcagtactatattaaatagaagtagtaaaagcaggcatccttgattttgctcttagggtaaaagctttcagtctttcattataatgttagctgtgtatttttttaatataaccttatgttaaggtgttttattcctttttatagcttattaagtatattttatcatgaatgtgggttaaattttgacaaattctttttcttctttgattaagatgatcacatgagggttttttccttctttatgttaatgtgatatgctgattttcatgtgttggaacatacttttatttcaggagtcaattatactcattcatagtgtataatccttttaatgtactgctaaatttgaattgctggtattttgttgaggatttttgcatcagcatttgtaagggatgtttgtttgtagttttcttatggtgcctttgtctgacttggtgtcggggtaatactgtctgcatagaatatgttagaaaatgttacctcctcttcaacgttttgaaaaagtttgagaaaaactggtgttaattctgctttaaacgttgggtagatttcaacagtgaagccatcttgtccaggcttttctttgttgctgggtttttgattactgatgtcatcttcttggtgaatctccttgctgaataggtttattcaacttttctgattcagtcttagtaggttttttgtttctaggaatttgttcattttatttaggttattcaattttttagtgtatagttccttatggtactctcatacatcctttttttactccaaaaatttgttagtaatgtacccattttatttttgagtttagtaatttgagtattccctttttttccttagtcaatctagataaaattttgtcagttttgatctttttcagagaacaaacttggttttgttgatttttcatattgtttttctcttctctatttcacttatttccactgctgtctttatcatttttaaaattttgctagcttttagttgtccctcttttagtagtccctctttttccctctgtttctagttccttaggagtaaagttgtttattcggtatcttattttttatcatttatagctataaatttttcccttatggtattgtttttgatgtatctctttcagtatttcatatttttaatttgtctctagatattttctattttctcttgtgatttcttttatccttccttgagtgtttatacctatattttcagacataaaatgtgaaacctacaaaattttcttgatttgttacagttttatttgttgtaagtttttattttagaattaaatgtgtgtatcaacatttgttatgttctcataagctttgtaatacagggagattcctggtccacatatataagcctctacatgaatatttttttgaagcatttaaccttctgttttaatatttcaaaggcctaaatgaaattgagattttggtttctgagatgaaatcatggtaggtgattgataaatgcttaaaaattagccaaaacttaaaattaagttaaagtttaccttcaagattcaacctgaatgagttgccctgtattgctggtagtaaaaaataagtctttaatggtataaaagcaaatttcagagaatgtttttttccccattgacatctaaattaaaagctgtaaaaaattttgattgccttatgcattttttactttagaattccaactttttctggttaaaattattccaaatagattcctgtgtatttgaaagacaattttttagttgaaatgcttaagcagttaaataaggccatgaaagtttcttgaacttgtgggaatccatgagaaaatctgacattatgttctattctcttggaaggtagaaatatcatttgacttctgttttgctgacaagaaatgtggtcctgaggtcctgagcaaggctacctgggataatgacctcacacatggaaaacgctggagcccatctgtctccaatctgctgttttccaaaaattagggaacttcagttttccctttgatactctctgtttctaacaaccccaacgccagggctgtcctgcttctacaagtgacaatgacaaatataggcctgaaggaagatgagctgatggcattcccagcttactaccactccttgggggccttatctcacatatgttgattcaattcatagactcaggtgggtgaggatctattgttcagctacattagaagtgactgcttaagactctggtgtgtggtgaaatgaggcagaattttctcaatggagtgttgggagaagtttctccttataattaccgtcttactatcactaaatcatagctcaaataaggaaattattcaagaagaaatagaaatgtaatcttatgaagacataaatttagagatttgtggaaagcccttcataatttcatggtgttctgtttgagctgggattatagttgatatttcattataatatattagctgttctagactttatgcatttatgtaaagttttctttgttgtactttaagttctgggatacatgggcagagcatgcaggtttgttccataggtatacacgtgccatggtggtttgcagcacccatcaacctgtcatctacattaggtatttctcctaatgctgttcctcccccagcctcccaccctttgacaggccccagtgtgtgatgttcccctccctgtgtccatgtgttctcattgttcaactcccacttatgagtgagaacatgcagtgtttggttttcttttcttctttttctttttctttctttttttttttgagacaaaatttcactcttgttgaccaggttggagtgcaatggcatgatcttgggttaccgcaacctctgcctcccgggttcaagtgactctcctgcctcagcctcccaagtagctaggattacaggcatgtgccaaaatgcctggctaattgtgtgtatttttagtagagatggggtttctccatgttggtcaggctggtctcaaactcctcacctcaggtgatctgcccacctttgcctcccaaagttctgagactacaggcatgagccactgctcctggcctggttttcttttcttgtgttagtttgctgagaatgatggtttccagcttcatccatgtccctggaaaggacataaatgtgtagtattccatggtgtatatgtgccacattttctttatccactttatcattgatgggaatttgggttggttccaagtctttgctattgtgaacagtgctgaaataaacatacagtgcatgtgtctgtatagtataataatttataatgctttgggtatataccccgtaatgggattgctgaaccttgaggaattgtcacactgtcttccataatgactgaactaatttacactcctaccaacagtgtaaaagcattcctatttctccacagcctcatcagcatctgttgtttcctgactttttaataatcaccattctaactggtgtgagatggtatctc

SEQ ID NO: 12748 - DNA, 5582 bp, Homo sapiens
tcaattgtattttctttgttattattatactttaagttttagggtacatgtgcacaacgtgcaggtttgttacatatgtatacatgtgccatgttggtgtgctgcacccattaactcgtcatttagcaataggtatatctcctaatgctatccctcccccctccccagaccacacaacagtccccagtgtgtgatgttccccttcctgtgtccatgtgttctcattgttcaattcccacctatgagtgagaacatgcggtatttggttttttgtccttgtgatagtttgctcagaatgatggtttccagcttcatccatgtccctaaaaaggacaggaactcattattttttatggctgcatagtattccatgtgtatatgtgccacattttcttaatccagtctatcattgttggacatttgggttggttccaagtctttgctattgtgaatagtgcctcaataaacacacgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacaatgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcacgtgttttttggctgcataaataaatgtcttctattgagaagtgtctgttcatatccttcgcccactttttaatggggttgtttgtttttttcttataaatttgtttgagttcattgtagattctggatattagccctttatcagatgagtaggttgcaaaaattttctcccattttgtaggttgcctgttcactctgatggtggtttcttttgctgtgcagaagctctttagtttaattagatcccatttgtcaattttggcttttgttgccattgcttttggtgttttagacatgaagtccttgcccatgcctatggcctgaatggtactgcctaggttttcttctagggtttttatggttttaggtcaaacatgtaagtctttaatccatcttgaattaatttttgtataaggtgtaaggaaggcatccagtttcagctttctacatatggctagccaattttcccagcaccatttattaaatagggaatcctttccccatttcttctttttgtcaggtttgtcaaagatcagatagttgtagatatgtggcattatttctgagggctctgttctgttccattggtctacatctctgttttggtaccagtaccatgctgttttggttactgtagccttgtagtatagtttgaagtcaggtagcgggatgcctccagctttgttcttttggcttaggattgacttggcaatgtgggctttttggttccatatgaactttaaagtagttttttccaattctgtgaagaaagtcattggtagcttgatggggatggcattgaatctataaattaccttgggcagtatggccattttcatgatactgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttactggtgtataagaatgctcgtgatttttgcacattgattttgtatcctgagactttgctgaagttgcttatcagcttgaggagatttggggctgagacaatggggttttctagatatacaatcatgtcatctgcaaacagggacaatctgacttcctcttttcctaattgaatgccctttatccccttctcctgcctcattttcttggccagaacttccaaccctatgttgaataggagtgttgatagagggcatccctgtcttgtgccagttttcaaagggaatgctcccagtttttgtccattcagtatgatattggctgtggggttgtcatagatagctcttattattttgagatatgtcccatcaatacctaatttattgagagtttttagcatgaagggttgttgaattttgtcaaaggccctttctgcatctattgagataatcatctggtttttgtctttggttctgtttatatgctggattacatttattgatttgcatatgttgaaccagccttgcatcccagggttgaagaccatttgatcacggtggataagctttttgatgtgttgctggattcggtttgccagtattttattgcggatttttgcatcaatgttcatcaaggatattggtctaaaattctctttttttgttgtgtctctgccaggctttggtatcaggatgatgctggcttcataaaatgagttagggaggattcccgttttctactgattggaatagtttcagatggaatagtaccagctcctctttgtacctctggtagaattcggctgtgaatccatctggtcctggactttttttggttggtaagctattaattattgcctcaatttcagagcctgttattggtctattcagagatttaacttcttcctggttttgtcttgggagagtgtatgtgtcaaggaatttatccatttcttctagattttctagtttatttgcatagaggtgcttatagtattctctgatggtagtttgtatttctgtgggatcggtggtgatatcccctttgtcattttttatggcgtctatttgattcttctctcttttcttctttattagtcttgctagcggtctatcaattttgttgatcttttcaaaaaaccagctcctggattcattgatttttttgaagggttttttgtctctatttccttcagtcctgctctgatcttagttatttcttgccttctgctagcttttgaatatgtttgctcttgcttctctagttcttttaattgtgatgttagggtgtcaatttttcatctttcctgctttctcttgtgggcatttagtgctataaatttccctctacacactgctttgaatatgtcccagagattctggtatgttgtgtctttgttctcattggtttcaaagaacatcttcatttctgccttcatttcattatgtacccagtagtcattcagaagcaggttgttcagtttccatgtagttgaggggttttgagtgagtttcttaatcctgagttctagtttgattgcactgtggtctgagagacagtttgttataatttctgttcttttacatttgctgaggagtgctttacttccaactatgtggtcaattttggaataggtttggtgtggtgctgaaaagaatgtatattctgttgatttggggtggagagttctgtagatgtctattaggtctgcttggtgcagagctgagttcaattcctgtatatccttgttaactttctgtctcgttgatctgtctaatgttgacagtggggtgttaacgtctcccattattattgtgtcggagtctaagtctctttgtaggtcactaagacttgctttatgaatctaggtgctcctgtattgggtgcatatatatttaggatagctagttcttcttgttgaattgattcctttaccattatgtaatggccttctttgtctcttttgatctttgttggtttaagtctgttttatccgagactaggattgcaatccctgcatttttttgttttccatttgcttggtagatcttcctccatccctttattttgagcctatgtatgtctctgcatgtgagatgggtttcctgaatacagcacactgatgggtcttgactctttatccaatttgccagtctgtgccttttaattggagcaatttagcgcatttacatttatggttagtattgttatgtgtgaatttgatcctgtctttatgatgttagctggttattttgctcgttagttgatgtagtttcttcctagccttgatattctttacaatttggcttgtttttgcagtggctggtaccggttgctcctttccatgtttagtgcttccttcaggagctcttttagggcaggcctggtggtgacaaaatctctcagcatttgcttgtctgtaaagtattgtatttctccttcacttatgaagcttagtttggttggatatgaaattctgggttgaaagttcttttctttaagaattttgaatattggtccccactctcttctggctcgtagagtttctggcaagagatcagctgttagtctgatgggcttccctttgtgggtaacccgacctttctctctggctgcccttaacattttttccttcatttaaactttggtgaatttgacaattatgtgtcgtggagttgctcttctctaggagtatcttagtggcgttctctgtatttcctgaatttgaatgttggcctgccttgctagattggggaagttctcctggataatatcctgcagagtgttttccaacttggttccattctccccgtcactttcaggtacaccaattagacgtagatttggtcttttcacatagtcccatatttcttggatgctttgtttctttttattcttttttctccaaacttctcttcatgcttcatttcattcatttcgtcttccatcactgataccctttcttccagttgatcacatcggttactgaagcttgtgcatttgtcacgtagctctcgtgctgtggttttcagctccatcaggtcctttaaggacttctctgcattgattattctagttatccattcatctaattttttttcaaagtttttaacttctttgccattgattcgaacttcctcctttagctcagagtagtttgatcttctgaagccttcctctctcaactcgtcaaagtcattctccgtccagctttgttctgttgctggtgaggagctgcgttcctttggaggagaagaggcgctctgatttttagagtttccggtttttctgctctgttttttccccatctttgtgattttatctacctttggtctttgatgatggttatgtacagatgggttttgggtgtggatgtcctttctgtttgttagttttccttctaacagtcagaaccctcagctgcaggtctgttggagtttactggaggtccactccagaccttgtttgcctgggtatcagcagtggtggctgcagaacagcggatattggttaaccgcaaatgctgctgcctgatcgttcctctggaagttttgtctcagaggagtacccggcagtgtgaggtgtcagtctgcccctactggggggtgcctcccagttaggctacttgggggtcagggacccacttgaggaggcagtctgcccattctcagatctcaagctgcatgctgggagaaccactgctctcttcaaagctgtcagacagggacatttaagtctgcagaggttactgctgtcttttgt

SEQ ID NO: 12749 - DNA, 6023 bp, Homo sapiens
taatattctttttttatatttttttttaattatactttaagttttagggtacatgtgcacaatgtgcaggttagttacatatgaatacatgtgccatgctggtgcgctgcacccactaacgcgtcatctaacattaggtatatctcccaatgctatccctccccactccccccaccccacaacagtccccagagtgtgatgttccccttcctgtgtccatgtgttctcattgttcaattcccacctatgaatgagaatatgcggtgtttggttttttgttcttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaaatggtgtgagatggttttgatttgcatttctctgatggccagtgatgatggcattttttcatgtgttttttggctgcataaatgtcttcttttgacaagtgtctgttcatgtccttcgcccactttttgatggggttgtttgtttttgtcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccacttgtcaattttgtcttttgttgccattgcttttggtgttttagacatgaagtccttgcccatgcctatgtcctgaatggtagtgcctaggtttacttctagggtttttatgcttctaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtgaaagatcagatagttgtagatatgcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggattgacttggcgatgcaggctcttttttggttccatatgaactttaaagtagttttttccaattctgggaagaaagtcattggtagcttgatggggatggcattgaatctgtaaattaccttgggcagtatggccattttcacgatattgattgttcctacgcatgagcatcgaatgttcttccatttgtttgtatcctcttttatttccttgagcagtggtttgtagttctccttgaagaggtccttcacatcccttgtaagttagattcctaggtattttattctctttcaagcaattgtgaatgggagttcactcatgatttggctctctgtctgttgttggtgtataagaatgcttgtgatttttgtacattgattttgtatgctgagactttgctgaagttgcttatcagcttaaggagattttgggctgagacaatggggttttctggatatacaatcatgtcatgtgcaaacacggacaatttgacttcctcttttcctaattgaataccctttatttccttctcctgcctaattgccctggccagaacttccaacactatgttgaataggagtggtgagagagggcatctctgtcttgtgccagttttcaaagggaatgcttccagtttttgcccattcagtatgacattggctgtgggtttgtcatagatagctcttattagtttgaaatacgtcccatcaatacctaatttattgagagtttttagcatgaagggttgttgaattttgtcaaaggctttttctgcatctattgagataatcatgtggtttttgtctttggctctgtttatatgctggattacatttgctgatttgcgtatattgaaccagccttgtatcccagggatgaagcccacttgatcatggtggataagctttttgatgagctgctggattcgttttgccagtattttattgaggatttttgcatcaatgttcatcaaggatattgatctaaaattctctttttttgttgtgtctctgcctggctttggtatcagaatgatggtggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtggtatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatcttccctgctttctgttgtgggcatttagtgctataaatttccctctacacactgctttgaatgtgtcccagagattctggtatggtgtgtctttgttctcattggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctaaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaatcttgctgctgctgtattgggtgcatatatatttaggatagttagctcttcttgttgaattgatccctttaccattatgtaatggccttctttgtctcttttgatctttgttggtttaaagtctgttttatcagagactaggattgcaaccccttcctttttttgttttccattggcttggtagatctttctccatccttttattttgagcctatgtgtgtctctgcacgtgagacgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagtgctaccttcaggagctcttgtaaggcaagcctggtggtgacaaaatctctcagcatttgcttgtctgtaaaggattttatttctccttcacttacgaagcttagtttggctggatatgaaattctgggttgaaaattctttcctttaagaatgttgaatattggcctccactctcttctggcttgtagggtttctgccaagagatctgctgttagtctgatgggcttccctttgtgggtaacccgacctttctctctggctgcccttaacattttttccttcatttcaactttggtgaatctgacaattatgtgtcttggagttgctcttctcgaggagtacctttgtggcgttctctgtatttcctgaatctgaatgttgccctgccttgctagattggggaagttctcctggataatatcctgcagagtgttttccaacttggttccattctccccatcactttcaggtacaccaatcagacgtagatttggtcttttcacatagtctcatatttcttggaggctttgctcatttctttttattcttttttctctaaacttcccttctcgcttcatttcattcatttcatcttccattgctgataccctttcttccagttgattgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcgtcaaagtcattctccatccagctttgttccgttgctggtgaggaactgcgttcctttggaggaggagaggcgctctgctttttagagtttccagtttttctgttctgtttttttcccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggggtgcctcccagttaggctgctcgggggtcaggggtcagggacccacttggggaggcagtctgcgggttctcagatctccagctgcgtgctaggagaaccactgctctcttcaaagctgtcagacagggacttttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagactacgtgggcgtcggaccctctgagccaggtgcggaatataatctcgtggtgcgccgttttttaagcccgtcagaaaagcgcaatattcgggtgggagtgacccgattttccaggtgccgtccgtcacccctttctttgactcagaaagggaactccctgaccccttgcgcttcccaagtgaggcaatgcctcgccctgcttcggctcgcgcacggtgcacgcacccactgacctgcgcccactgtctggcactccctagtgagatgaacccggtacctcagatggaaatgcagaaatcacccgtcttctgcgtcactcacgctgggagctgtagaccggagccgttcctattcggccatcttggctcctccc

SEQ ID NO: 12750 - DNA, 6067 bp, Homo sapiens
ttttatttatttatttatttattttattattattattatacttttaagttttagggtacatgtccatattgtgcaggttagttacgtatgtacacatgtgacatgctggtgcgctgcacccactaactcgtcatctagcattaggtgtatctcccaatgccatccctcccccctccccccaccccacaacagtccccagagtgtgatattccccttcctgtgtccatgtgatcgcattgttcaattcccacctatgagtgagaatatgcgatgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgctttttggtgttttagacatgaagtccttgcccatgcctatgtcctgaatggtaatgcctaggttttcttctagggtttttatggttttaggtctaacatttaagtctttaatccatcttgaattaattttgtataaggtgtaaggaagggatccagtttcagctttctacatatggctagccagttttcccagcaccatttattaaatagggaatcctttccccattgcttgtttttctcaggtttgtcaaagatcagatagtcgtagatatgcggcgttatttctgagggctctgttctgttccattgatctatatctctgttttggtaccagtaccatgctgttttggttactgtagccttgtggtatagtttgaagtcaggtagtgtgatgcctccagctttgttcttttggcttaggattgacttggtgatgcgggcttttttttggttccatgtgaactttaaagtagttttttccaattctgtgaagaaaggcattggtagcttgatggggatggcattgaatctgtaaattaccttgggcagtatggctattttcacgatattgattcttcctacccatgagcatggaatgttcttccgtttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaaacagggacaatttgacttcctcttttcctaattgaataccatttatttccttctcctgcctaattgccctggccacaacttccaacactatgttgaataggagtggtgagagagggcatccctgtcttgtgccagttttcaaagggaatgcttccagtttttgcccattcagtatgatattggctgtgggtttgtcaaagatagctcttattattttgaaatacgtcccatcaatacctaatttattgagagtttttagcatgaagggttgttgaattttgtcaaaggctttttctgcatctattgagataatcatgtggtttttgtttttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaatcgtctttttttgttgtgtctctgcctggctttggtatcagaatgatgctggcctcataaaatgagttagggaggattccctctttttctgttgattggaatagtttcagaaggaatggtaccagttcctccttgtacttctggcagaatttggctgtgaatccatctggtcctggactctttttggttgggaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatgtcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccaaggattctggtatgttgtgtctttgttctcgttggtttcaaagaacatctttatttctgccttcatttcgttatgtacccagtagtcattcaggagcaggttgttcagtttccatgtatttgagaggttttgagtgagattcttaatcctgagttctagtttgattgcactgttgtatgagagatagtttgttataatttctgttcttttacatttgctgaggagagctttacttccaagtatgtggtcaattttcgaataggtgtggtgtggtgctgaaaaaatgtatattctgttgatttggggtagagagttctgtagatgtctattaggtctgcttggtgcagagctgagttcaattcctgggaatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatacttagaatagttagctcttcttgttgaattgatccctttaccattatgtaatggccttctttgtctcttttgatctttgttggtttacagtctgttttatcagagactaggattgcaacccctgcctttttttgttttccatttgcttggtagatcttcctccatccttttattttgagcctatgtctgtttctgcacgtgagatgggcttcctgaatacagcacactgatgggtcttgactctttatccaatttgccagtctgtgtcttttaattggagcatttagtccatttacacttaaagttaatattgttatgtgtgaatttgatcctgtcattatgatgttagctggttattttgctcgttagttgatgcagtttcttcctagtctcgatggtctttacatgttggcatgattttgcagcggctggtaccggttgttcctttccatatttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattctttcctttaagaatgttgaatattggcccccactctcttctggcttgtagggtttctgccaagagatccgctgttagtctgatgggcttccctttgagggtaagcagacctttctctctggctgcccttaacattttttccttcatttctactttggtgaatctgacaattatgtgtcttggagttgctcttctcgaggagtatctttgtggcgttctctgtatttcctgcatctgaacgttggcttgccttgctagattggggaagttctctggataatatcctgcagtgtgttttccaacttggttccattctccccatcactttcaggtacaccaatcagacgtagatttggtcttttcacatagtcccatagttcttggaggctttgctcatttctgttcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcaaactgcattcctttggaggaggagaggcgctctgatttttagagtttccagtttttctgttctgttttttccccatctttgtggttttatctacttttgatctttgatgatggtgatgtacagatgggtttttggtgtggatgtcctttctgtttgttagttttccttctaacagacaggaccctcagctgcaggtctgttggaataccctgcagtgtgaggtgtatcagtgtgcccctgctgggggtgcctcccagttaggctgctcgggggtcaggggtcagggacccacttgaggaggcagtctgcccgttctcagatctccagctgcgtgctgggaaaaccagtgctctcttcaaagctgtcagacagggacatttaagtctgcagaggttactgctgtctttttgtttgtctgtgccctgcccccagaggtggagcctgcagaggcaggcaggcctccttgagctgtggtgggctccaccctgttggaacttcccagctgctttgtttacctaatcaagcctgggcaatggcgggcgcccctcccccagcctcgctgctgccttgcagtttgatctcagactgctgtgctagcaatcagcgagactccgtgggcgtaggaccctccgagccaggtgcgggatataatctcgtggtccgccgtcttttaagcccgtcagaaaagcgcagtattccggtgggagtgacccgattttccaggtgctgtccatcacccctttctttgactcggaaagggaactccctgaccccttgtgcttccggagtgaggcaatacctcgccctgcttcggctcgcgcacgatgcacgcacccactgacctgcgcccactgtctggcactccctagtgagatgaacctggtacctcagatggaaatgcagaaatcacccgtcttctgcgttgctcacgctgggagctgtagaccagagctgttcctattcggccttcttggctccttccctgggctcttt

SEQ ID NO: 12751 - DNA, 5236 bp, Homo sapiens; identical to SEQ ID NO: 12618

SEQ ID NO: 12752 - DNA, 4316 bp, Homo sapiens
tctgtatgttttgtatttttcttttttaaaattttattattattatactttaagttttagggtacgtgtacacaacgtgcaggtttgttacatatgtatacatgtgccatgttggtgtgctgtacccattaactcgtcatttaacattaggtatatctcctaatgctatctctccccacttcccccaccccacaacaggccccggtgtgtgatgttccccttcttgtgtccatgtgttctcattgttcaattcccacctatgagtgagaacatgcggtgtttggttttttgtccttgcaatagtttgctgagaatgatggtttccagcttcatccatgtccctacaaaggatatgaactcatcactttttatggctgcatagtattccatggtgtatatgtgctacattttcttaatccagtctatcattgttggacatttaggttggttccaagtctttgctattgtgaatagtgccgcaataaacatacgtgtgcctgtgtctttatagcagcatgatttataatcctttgggtatatacccagtaatgggatggctgggtcaaatggtatttctagttctagatccctgaggaatcgccacactgacttccacagggttgaactagtttacagtcccaccaacagtgtaaaagtgttcctatttctccatatcctctccagcacctgttgtttcctgactttttaatgatcgccattctaactggtgtgagatggtatctcattgtggttttgatttgcatttctctgatggccagtgatgatgagcattttttcatgtgttttttggctgtataaatgtcttcttttgagaagtgtctgttcatatccttcgcccactttttgatggggttgtttgttttttttcttgtaaatttgtttgagttcattgtagattctggatattagccctttgtcacatgagtaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtattgcctaggttttcttctagggtttttatggttttaggtctaacatttaagtctttaatcaatcttgaattaatttttatataaggtgtaaggaagggatccagtttcagctttctacatatggttagccagttttcccagcaccatttattaaatagggaatcctttccccatttcttgtttttgtcaagtttgtcaaagatcagatagttgtagatatgtggcattatgtctgagggctctgttctgttccattggtctatatctctgttttgtaccagtaccatgctgttttggttactgtagccttgtagtatagtttgaagtcaggtagcatgatgccttcagctttgctcttttggcttaggattgactgggcaatgcgggctcttttttggttccatatgaactttcaaatagttttttccaattctgtgaagaaagtcattggtagcttgatggggatggcactgaatctgtaaattaccttgggcagtatggccattttcacaatattgattcttcctacccattagcatggaatgtttgtatcctctttcattgtattgtatcttgtattgtatcctcttttatttcattgagcagtggtttgtagttctccttgaagaggtccttcacatcccttgcaagttggattcctaagtattttattctctttgaagccattgtgaatgggagttcactcatgatttggctctctgtttgtctgttattggtgtataagaatgcttgtggtttttgcacattgattttgtatcctgagactttgctgaagttgcttatcagcttaaggagattttgggctgagacaatggggttttctagatatacaatcatgtcatctgcaaacagggacaatttgacttcctcttttcctaattgaatgcccgttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaataactaatttattgagagtttttaccatgaagggttgttaaattttgtcaaaggccttttctgcatctattgagataatcatatggtttttgtcattggttctgtttatatgctggattacgtttattgatttgtgtatgttgaaccagccttgcatcccagagatgaagctcacttgatcatggtggataagctttttgatgtactactggattcggtttgccagtattttactgaggatttttgcatcaacgttcatcaaggatattcgtctaaaattctcttttttttgttgtgtctctgccaggctttggtatcaggatgatgctggcctcataaaatgagttagggaggattccctctttttctattgattggaatagtttcagaaggaatggtaccagttcctccttgtacctctggtagaatttggctgtgaagccatctggtcctggattttttttggttggtaagctattaattattgcctcaatttcagaatctgttattggtccattcagggattcaacttcttcctggtttagtcttgggagggtgtatgtgtctaggaatttatccatttcttctagattttctagtttatttgcatggaggtgtttatagtattctctgatggtattttgtatttctgtgggatcagtggtgatatcccctttgtcattttttattgcatctatttgattcttctctctttttttctttattagtcttgctagctgtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctggttcttttaattgtgatgttagggtgtcaattttaaatctttcctgctttctcttgtgggcatttagtgctataaagttccctctacacactgctttgaatgtgtcccagagattctggtatgtcgtgtctttgttcttgttggtttcaaagaacatctttatgtctgccttcattttattatgtacccagtagtcattcaggagcaggttgttcagtttccgtgtatttgaggggttttgagtgagtttctgaatcctgagttctagtttgattgtactgtggtctgagagacaattttttataatttctgttctttacatttgctgaggagtactttacttccaactatgtggccaattttggaataggtgtggtgtggtgctgaaaagaatgtatattctgttgatctggggtggagggttctgtagatgtctgttaggtctgcttggtgcagagctgagttcaattcctggatatccttgtgaaatttctgtctcgttgatctgtctaatgttgacagtggggtgttaaagtctcccattatttttgtgtgggagtctaagtctctttttatgtcactaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaagccctgcctttttttgttttccatttgcttggtagatcttcctccatccctttattttgagcatatatgtgtctctgcatgtgagatgggtttcctgaatacagcacattgatgggtgttgactctttatccaatttgccagtctgtgtcttttaattggagcatttagcccatttacatttaaggttaatattgttatgtgtgaatttgatcctgtcattataatgttagctggttattttgctcgttagttgatgcagtttcttcctagccttgatggtctttacaatttggcatgtttttgcagcggctggtaccacttgttcctttccatgtttagtgcttccttcaggagctcttttagggcaggcctggtggtgacaaaatctctcagcatttgcttgtctgtaaaggattttatttcttcttcacttatgaagctt

SEQ ID NO: 12753 - DNA, 6032 bp, Homo sapiens
actattttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtctgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacacctatgtcctgaatggtaatgcctaggttttcttctagggtttttatggttttaggtttaacgtttaaatctttaatccatcttgaattgatttttgtataaggtgtaaggaaggaatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtagcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttatgcattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattcgtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatgtctgccttcatttcgttatgtacccagtagtcattcaggagcaggttgttcagtttccatgtagttgagcggctttgagtgagattcttaatcctgagttctagtttgattgcactgtggtctgagagatagtttgttataatttgtgttcttttacatttgctgaggagagctttacttccaagtgtgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttagtattgttatgtgtgaatttgatcctgtcattatgatgttagctggtgattttcctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgcattgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgagttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacatttaagtctgcagaggttactgctgcctttttgtctgtctgtgccctgcccccagaggtggagtctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcgctccctagtgagatgaacccggtacctcagatggaaatgcagaaatcacccgtcttctgcgtcgctcaccctgggagctgtagaccggagctgttcctattcggccatcttcgc

SEQ ID NO: 12754 - DNA, 6071 bp, Homo sapiens
tttttttttttcttttacttatttatttaacttttccttttttttctttaattatactttaagttttagggtacatgtgcacattgtgcaggttagttacaaatgtatacatgtgccatgctggtgcactgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaataatgctacaacaaacatacgtgtgcatgtgtctttatagcagcatgatttatagtcctttgggtatatacccagtaatgggatggctgggtcaaatggtatttccagttctagatccctgaggaatcgccacactgacttccacaacggttgaactagtttacagtcccaccaacagtgtaaaagtgttcctatttctccacatcctctccaacacctgttgtttcctgactttttaatgattgccattctaacaggtgtgagatggtatctcattgtggttttgatttgcatttctctgatggccagtgatggtgagcattttttcatgtgttttttggctgcataaatgtcctcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccatgcccatgcctatgtcctgaatggtaatgcctaagttttcttctagggtttttgtggttttaggtctaacgtttaagtctttaatccatcttgaattgatttttgtataaggtgtaaggaagggatccagtttcagctttctacatatggctagccagttttcccagcaccatttattaaatagggaaccctttccccattgcttgtttttgtcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctctagctttgttcttttggcttaggattgctttggtgatgtgggctcttttttggttccatatgaactttaaagtggttttttccaattctgtgaagaaagtcattggtagcttgatggggatggcattgaatctgtaaattaccttgggcagtatggccattttcacgatattgattcttcctacccatgagcatggaatgttcttccatttgtttgcatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagttttttcccattcagtatgatattggctgtgggtttgtcatagatagctcttattattttgaaatacgtcccatcaatacctaatttattgagagtttttagcatgaagagttgttgaattttgtcaaaggccttttccgcatctattgagataatcatgtggtttttgtctttggctctgtttatatgctggattacatttattgatttgcatatattgaaccagccttgcctcccagggatgaagcccacttgatcatggtggataagctttttgatgtgctgctggattcggtttgccagtattttattgaggatttttgcatcaatgttcatcaaggatattggtctaaaattctctttttttgttgtgtctgtgcctggctttggtatcagaatgatgctggcctcataaaatgagttagggaggattccctctttttctattgattggaatagtttagaaggaatggtaccagttcctccttgtacctctggtagaattcgcctgtgaatccatctggtcctggactttttttggttggtaagctattgattattgccacaatttcagctcctgttattggtctattcagagattcaacttcttcctggtttagtcttgggagagtgtatgtgtccaggaatttatgcatttcttctagattttctagtttatttgcgtagaggtgtttgtagtattccctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggacatttagtgctataaatttccctctacagactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggtattgagtgagattcttaatcctgagttctagtttgattgcactgtggtctgagagatagtttgttataatttctgttcttttacatttgctgaggatttcttcacttccaactaagtggtcagttttggaataagtgccatgtgatgctgacaaagatatatatgctgttgatttggggtggagagttctttagatgtctattaggtccgcttggtgcagagctgagttcaattcctgggtatccttgctgactttctgtcttgttgatctgtctaatgttgacagtggggtgttaaagtctcccattattaatgtgtgggagtctaagtctctttgtaggtcactcaggacttgctttatgaatcttggtgctcatgtattgggtgcatatatatttaggatagttagctcttcttgttgaattgatccctttaccattatgtaatggccttctttgtctcttttgatctttgttggtttaaagtctgttttatcagagactaggattgcaaccccttccttttttggttttccattggcttggtagatcttcctccatccttttattttgagcctatgtgtgtctctgcatgtgagatgggtttcctgaatacagcacactgttgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtcttgatggtctttatattttggcatgattttgcagtggctggtaccggttgttcctttccatgtttagtgcttccttcaggagctcttgtaaggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatcttcgtggcattctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgttcatttctttttattcttttttctctaaacttcccttctcgcttcatttcattcatttcatcttccatcgctgataccctttcttccagttgatcgcatcggctcctgaggcttctgcattcttctcgtagttctcgagccttggttttcagctccatcagctcctttaagcacttctctgtattggttattctagttatacattcttctaaatttttttcaaagttttcaacttctttgcctttggtttgaatgtcctcccgtagctcagagcaatttgatcgtctgaagccttcttctctcagctcgtcaaagtcattctccatccagctttgttccgttgctggtgaggaactgcgttcctttggaggaggagaggtgctctgctttttagagtttccagttcttctgttccgttttttccccatctttgtggttttatctacttttggtctttgatgatggtgatgtacagatgggtttttggtgtggatgtcctttctgtttgttagttttccttttaacagagaggaccctcagctgcaggtctgttggagtacccggccgtgtgaggtgtcagtgtgcccctgctggggggtgcctcccagttaggctgctcggggatcaggggtcagggacccacgtgaggaggcaatctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgatctgtggtagtctccacccagttggagcttcccggctgctttgtttacctaagcaagcctgggcaatggagggcgcccctcccccagcctcgctgccgccccgcagctccatctcagagtgctgtgctagcaaccagtgagactccgtgggcgcaggaacctccgagccaggtgcgggatacaatctcgcggtgcgccgctttccaagcccgtcggaaaagcgcagtattcgggtgggagtgacccgattttccaggtgccgtccgtcacccctttctttgactcagaaagggaactccctgaccccttgcgcttcccaagtgaggcaatgcctcgtcctgcttcgggtcgcgcacggtgcgcacacccactgacctgcgcccactgtctggcactccctagtgagatgaacccggtacctcagatggaaatgcagaaatcacccgtcttctgcgtcgcttactctgggagctgtagaccggagctgctcctattcggccatcttggctcctcctcctc

SEQ ID NO: 12755 - DNA, 5483 bp, Homo sapiens
atcttttttttaaattttattattattatactttaagttttagggtacatgtgcacaatgtgcacgtttgttacatatgtatacatgtgccatgttggtgtactgcacccattaactcgtcatttagcattagatatatctcctaatgctatccctcccccctccccccaccccacaacagtcaccggagtgtgatgttccccttcctgtgtccatgtgttctcattgttcagttcccacctatgagtgagaacatgcggtgtttggttttttgtccttgtgatagtttgctgagaatgatggtttccagtttcatccatgtccgtataaaggacatgaactcatcgttttttatggctgcatcgtattccatggtgtatatgtgccacattttcttaatccaatctatcgttgttggacatttgggttggttccaagtctttgctattgtgaatagtgccgcagtaaacatacgtgtgcatgtccctttatagcagcatgatttataatcctttgggcccagtaatgggatggctgggtcaaatggtatttctagttctagatccctgaggaatcgccacaccgacttccacaatggttgaactagtttacagtcccaccaacagtgtaaaattgttcctatttctccacatcctctccagcacctgttgtttcctgactttttaatgatcgccattctaactagtgtgagatggtatctcattgtggttttgatttgcatttctctgttggccagtgatgatgagcattttttcatgtgttttttggctgcataaatgtcttcttttgagaagtgtctgttcatatcctttgcccactttttgatggggttgtttgtttttttcttgtaagtttgtttgagttcattgtagattctggatattagccctttgtcagatgagtaggttgcaaaaatgttctcccattctgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttctataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagagctctgttctgttccattgatctatatctctgttttggtaccagtaccatgctgttttggttactgtagccttgtagtatagtttgaagtcaggtagcgtgatgcctccagctttgttcttttggcttaggattaacttggcgatgcgggctcttttttggttccatatgaactttaaagtagtttttttccaattctgtgaagaaagtcattggtagcttgatggggatggcattgaatctataaattaccttgggcagtatggccattttcacgatattgattcttcctacccatgagcatggaacgttcttctatttgtttgtatcctcttttatttcattgagcagtggtttgtagttcttcttgaagaggtccttcacatcccttgtaagttggattcctaggtattttattctctttgaagcaattttgaatgggagttcacttatgatttggctttctgtttgtctgttattggtgtataagaatgcttgtgatttttgtacgttgattttgtatcctgagactttgctgaagttgcttatcagcttaaggagattttgggctgagacaatggggttttctagatatacaatcatgtcatctgcaaacagggacaatttgacttcctcttttcctaatcgaataccctttatttccttctcctgcctaattgccctggccagaacttccaacactatgttgaataggagtggtgagagagggcatccctgtcttgtgccagttttcaaagggaatacttccagtttttgcccattcagtatgatattggctgtgggtttgtcatagatagctcgtattattttgaggtatgtcccgtcaatacctaatttattgagagtttttagcatgaagcattgttgaattttgtcaaaggccttttctgcatctattgagataatcatgtggtttttgtctttggttctgtttatatgctggattacatttattgattttcatatgttgaaccagccttgcatcccagggataaagcccacttggttatggtggataagctttttgatgtgctgctggattcggtttgccagtattttattgaggatttttgcatcaatgttcatcaaggatatcggtctaaaattctcttttttggttgtgtctctgccaggctttggtatcaggatgatgctggcctcataaaatgagttagggaggattccctctttttctattgattggaatagtttcagaaggaatggtaccagctcttccttgtacctctggtagaattcggctgtgaatccatctggtcctggactctttttggttggtaagctattgattattgccacaatttcagatcctgttattggtctattcagagattcaacttcttcctggtttagtcttgggagggtggatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattctttcctcttttcttctttattagtcttgctaacagtctatcaattttgttgatcttttcaaaaaaccagctcctggattcattgattttttgaagggttttttgtgtctctgtttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttttcattggtttcaaagaacatctttatttctgccttcatttcgttatgtacccagtaatcactcaggagcaggttgttcagtttccatgtagttgagcggttttgagtgagtttcttaatcctgagttctagttttattgcactgtggtctgagagacagtttgtcataatttctgttcttttacatttgctgaggagtgctttacttccaactatgtggtcagttttggaataggtgtggtgtggtgctgaaaagaatgtatattctgttgatttggggtagagagttctgtagatgtctattaggtcagcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattggatgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctatccaatttgccagtctgtgtcttttaattggagcatttagcccatttacatttaaagttaatattgttatgtgtgaatttggtcctgtcattatgatgttagctggttattttgctcattagttgatgcagtttcttcctagccttgatggtctttacattttggcatgtttttgcagtggctgataccggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagcttctgccaagagatctgctgttagtctgatgggcttccctttgtgggtaacccaacctttctctctggctgcccttaacattttttccttcatttcaactttggtgaatctgacaattatgtgtcttggagttgctcttcttgaggagtatctctgtggcgttctctgtatttcctgaatctgaatattggcctgcattgctagattggggaagttcttctgggtaatgtcctgcagagtgttttccaacttggttccattctccccgtcactttcaggtacaccaatcagatgtagatttggtcttttcacatagtcccatatttcttggaggccttgttcgtttctttttattcttttttctctaaacttcccttcttgcttcatttcattcatttcatcttccatcactgataccctttcttccagttgattgcattggctcctgaggcttctgcattctttacgtagttctcgagccttggctttcagctccatcaggtcctttaaggacttgtctgcattggttattctagttatccattcatctaatttttttttcaaagtttttaacttctttgccattggtttgaatttcctcctgtagcttggagtagtttgatcgtctgaagccttctctcaacttgtcaaagtcattctccgtccagctttgttccgttgctggtgaggagctgtgttcctttggaggaggagaggtgctctgctttttagagtttccagtttttctgctctgttttttccccatctttgtggttttatctacttttggtctttgatgatggtgacgtacagatgggtttttggtgtggatgtcctttctgtttgttagttttccttctaacagataggaccctcagctgcacgtctgttggagtttgctagagatccactccagatgctgtttgcctgggtatcagcagtggtggctgcagaacagcggtggctgtagaacagcggatattggtgacctgcaaatgctgctgcctgatcattcctctggaagttttgtctcagaggagtacctggctgtgtgaggtgtcagtctgcccctactggggggtgccctcccagttaggctgcttgggggtcagggacccact

SEQ ID NO: 12756 - DNA, 5583 bp, Homo sapiens
gtttttatttttatttatttatttttttattattattatactttaaattttaggatacatatgcacaacgtgcaggtttgttacatatgtatacatgtgccatgttggtgtgctgcacccattaactcatcatttagcattaggtatacctcctaatgctatccctccccgctccccccaccccacaacagtccctggtgtgtgatgttccccttcctgtgtccatgtgttctcattgttcaattcccacctatgagtgagaacatgcggtgtttggtttttttgtccttgcgatagtttgctgagaatgatggtttccagcttcatccatgtccctacaaaggacatgaactcatcattttttatggctgcatagtattccatggtgtatatgtgtcacattttcttaatccagtccatcattgttggacatttgggttggttccaagtctttgctattgtgaatagtgctgcaataaacgtacatgtgcatgtgtatttatagcagcatgatttataatcctttgggtatatgcccagtaataggatggctgggtcaaatcgtatttctagttctagatccctgaggaatcgccacactgacttccacaatggttgaactagtttacagtcccaccaacagtgtaaaagtgttcctatttctccacatcctctccagcacctgttgtttcctgactttttaatgatctccattctaactggtgtgagatggtatcgcattgtggttttgatttgtatttctctgatggccagtgatgatgaacattttttcatgtgttttttggctgcataaatgtcttcttttgagaagtgtctgttcatatcctttgcccactttttgacggggttgtttgtttttttcttataaatttgtttgagttcattgtagattctggatattagccctttgtcagatgagtaggttgcaaaaattttctcccattctgtaggtttcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatacatcttgaattaatttttgtataaggtgtaaggaagggatccatttcagctttctacatatggctagccagttttcccagcagcatttattaaatagggaatcctttccccattgcttgtttttgtcaggtttgtcaaagatcagatagttgtagatatgcagcattatttctgagggctctgttctgttccattggtctatatctctgttttggtacgagtaccatgctgttttggttactgtagccttgtagtatagtttgaagtcaggtagcatgatgcctccagctttgttcttttggcttaggattgacttggtgatgtgggctcttttttggttccatatgaactttaaagtagttttttccaattctgtgcagaaagtcattggtagcttgatggggatggcattgaatctataaattaccttgggcagtatggctattttcacgatattgattcttcctacccacgagcatggaatgttcttccatttgtttgtatactcttttatttcattgagcagtcgtttgtagttccccttgaagaggtccttcatgccccttgtaagttggattcctaggtattttattcttttgaagcaattgtgaatgggagttcaactcatcatttggctctctgtttgtctgttattgatgtataagaatccttgtgatttttgcacattgattttgtatcctgagactgctgaagttgcttatcagcttaaggagattttgggctgagacaatggggttttctagacattcaatcatgtcatctgcaaacaggaacaatttgacttcctcttttcctaattgaatgccctttatttccttctcctgcctgattgccctggccagaacttccaacactatattgaataggagtggtgagagagggcatccctgtcttgtgccagttttcaaagggaatgcttccagtttttgtccattcagtatgatattggctgtgggtttgtcatagatagctcttattattttgagatacgtcttatcaatacctaatttattgagaatttttagcgtgaagcattgttgaattttgtcaaaggtcttttctgcatctattgagataatcatgtggtttgtgtctttgtttctgtttatatgctggattacgtctattgattttcgtatgttgaaccaggcttgcatcccagggatgaagcccacttgatcatggtggataagctttttgatgtgttgctggatgcggtttgccagtattttattgaggatttttgcatcaatgttcatcaaggatattggtctaaaattctcttttttttgttgcgtctctgcccggctttggtatcaggatgatgctggcctcataaaatgagttagggaggattctctcattttctattcattggaatagtttcagaaggaacggtaccagctcctccttctacctatggtagaatttggctgtgaatccatcttgtcctggacttttttttggttggtaagctcttaattattgcctcaatttcagagcttgctattggtctcttcagagattcaacttcttcctggtttagtcttgggagagtgtatgtgtcaaggaatttatccatttcttctagattttctagtttatttgcatagaggtgtttatagtattctctgatggtagtttgtatttctgtgggatcggtggtgatatcccctttgtcattttttattgcgtctctttgattcttctctcttttcttctttattagtcttgctagcggtctatcaattttgttgatcttctcaaaaaaccagctcctggattcattgattttttgaagggttttttttgtctctatttccttcagttctgctctgatcttagttatttcttgccttctgctagcttttgaatgtgtttgctcttgcttcgctagttcttttaattgtgatgttagggtgtcaattttagatctttcctgctttctcttgtgggtatttagtgctataaatttccctctatgcactgtttttaaagtgtcccagagattctggtatgttgtgcctttgttctcattggtttcaaagaacatctttatttctgccttcatttcgtgtacccagtagtcattcaggagcaggttgttcagtttccatgtagttgagcagttttgagtgagtttcttaatcctgagttctagtttgattgcactgtggtctgagagacagtttgtcataatttctgatcttttacatgtgctgaggagtggtttacttccaactatgtggtcaattttggaataggtgtggtgtggtgctgaaaagaatgtatattctgttgatttggggtggagagttctgtagatgtctattaggtctgcttggtgcagagctgagttcaattcctggatatccttgttaactttctgtctcattgatctgtctaatattgacagtgggctgttaaagtctcccattattattgtgtgggaatctaagtctctttgttggtctgtaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatccgagactaggattgcaacccctgcctttttttcttttccgtttgcttggtagatcttactccattcctttatttttagcctatgtgtgtctctgcacatgagataggtttcctgaatacagcacactgatgggtcttgactctttatccaatttgccaatctgtgccttttaattggagcatttagcccatttacatttaaggttagtattgttatgtgtgaatttgatcctatcattatgatgttagctggttagtttgctcattagttggtgcagtttcttcctagccttgatggtctttacaatttggcatgtttttgcactggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggaaatgaaattctagcttgaaaattcttttctttaagaatgttgaatattggcctccactctcttctggcttgtagagtttctgccgagagatcagctgttagtctgatgggcttccctttgtgggtaacccgacctttctctctggctgcccttaacattttttccttcacttcaactttggtgaatctgacaattacgtgtcttggagttgctcttctcgaggagtatctttgtggcattctctgtatttcccgaatttgaatgttggcctgccttgctagattggggaagttctcctggataatatcctgcagagtgttttccaacttggttccattctccctgtcactttcaggtacaccaattagacgtagatttggtcttttcacatagtcccatatttcttggaggctttgtttgtttctttttattctttttcctctaaacttctcttcacacttcatttcattcatttcatcttccatcgctgataccctttcttccagttgatcgcatcagttactgaggcttgtgcattcatcacgtagttctggtgccttggttttcagctccatcagttcctttaagtacttctctgcattgcttattctagttagccattcatctaatttttttttcaaagtttttaacttctttgccattggttagaacttcctcctttagctcggagtagtttgatcttctgaagccttcctctctcaactcgtcaaagtcattctccatccagctttgttccattcctggtgaggagctgcgttcctttggaggaggagaggcgctctgatttttagagtttctggtttttctgctgttttttcccatctttgtggttttatctacctttggtctttgatgatggtgacgtacagatggatttttggtgtggatgtcctttctgttttttagttttccttctaacagtcaggaccctcagctgcaggtctgttggagtttactggaggtccactgcagaccctgtttgcctgggtatcagcagcagtagctgcagaacagcggatattggtgaaccgcaaatgctgctgcctgatcattcctctggaatttttgtctcagaggagtacccggccgtgtgaggtgtcagtctgcccctactggggggtgtctcccagttaggctactcgtgggtcagggacccacttgaggaggcactctgctcattctcagatctcaagctgcatgctgggagaaccactactctcttcaaagctatcagacagggacatttaagactgcagaggttat

SEQ ID NO: 12757 - DNA, 7185 bp, Homo sapiens
ttccagtttgggataattatgaatgaagctattgtgaacatttgtttacaagtgtttttatggccatgttttcatttctcttgggtaaatacctataatggaattgctgaattatatagcaattagtgtatgattaactttataggaaatatatatggttagtgtatgattaactttataagaaaccgccagacaaatttgccagagtggttgttaagtgtctcatcccactaacaatggagaagagttcccattgctctacatcctcatcaacacttaaaatggtgaaaacgctttaaattgttaatattttggtcattttaataggtatgtaatggcatttcattgtgattgtaacttgtacttctctaatgagtaatgttgttgagtatactttttcatgtgtttcttggccatttgaatattatcttttgtgacaaatattgcaaacatggtagctgaagacaaattatttactttgctcacaaaatggcaatttgatcagagctcgttgaagacaactaaatgtctgctctgcatggcatcagccagggcaacttgaaggctgagggtaattcaacagccgggaactgaaatcatctgaagactcactcattcctgtgtctgaagttgatgctggccctcagctggatctcgagggaggccattggccagaacacctcctcatggcctctccatgtagcagtttggcctgctgggttccaaaagcatcccaagagaacgaagtggaagttcatggcgtcttatgacctagcttcagtcacagtgttattttcacaatacgctaatggttgaggcagtcactcaggtgcaaggggaggggtcatagccaccacctctcaatggaagaagtgtcagcatcatgtcagggaaaaaaacttgtggaatggaatatactgtggggatatctttggaaaatacaatctgtcacatgtctgtccaaatcttttactcattgctttgtgttgttttcctattatccagttaaaatctttacgttttctggaaatgagtcctttttctgtctgaagcttgacttttcattttcttcatggtgtctcagaaagagtaaacattttttcatttgaacgaagcccatctatcgattttgtcttttaaggtagtactttttgtttcctgcctaaaacatttgtgcctaccccaggctcttcaatattttcttgtataatttttttagtttcagtgtttatgtctagatttctaattcatttcaagtgaactttttttttattactatactttaagttttacggtacatgtgcacaatgtgcaggttagttacatatgtatacatgtgccatgttagtgtgctgaaccctgtaactcatcatttaacattaggtatatctccaaatgctatccctccctcataacccaccgacaacaggccctggtatgtgatgttccccttcctgtgtccaagtgttctcattgttcaattcccacctatgagtgagaacatgtggtgtttggttttttgtccttgcaatagtttgctgagaatgatggtttccagctccatccatgtccctacaaaggacatgaactcatcattttttatggctgcatagtattccatgctgtatatgtgccccatattcttaatccagtctattgttgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctgtttctccatatcctctccagcacctgttttttcctgactttttaatgattgccattctaactggtgtgagatggtatctcattgtggttttgatttgcatttctctgatgtccagtgatgatgagcattttttcatgtgtcttttggctgtataaatgtcttcttttgagaaatgtctgttcatatccttcgcccacttgttgatgggcttgtttttttcttgtaaatttgtctgagttcattgtagattctggatattagccctttgtcagatgagtagattgcaaaaattttctcccattctgtaggttgcctgttcactctgatgatagtttcttttgctgtgcagaagctctttagtttcattagatcccatttgtcaattttggcttttgttgccattgcttttggtgttttagacatgaagtccttgcccatgcctatgtcctgaatggtattgcctaggttttcttctagggtttttatggttttaggtctaagatttaagtctttagtccatcttgaattaatttttgtataaggtgtaaggaagggatccagtttcagctttctccatatggctagccagttttcccagcactaattattaaatagggaatcgtttccccatttcttgtttttgtcaggtttgtcaaagatcagatggttgtagatatgcggcattatttctgagggctctgttcggttccattgctctatatctctgttttggtaccagtaccatgctgtcttggttactgtagccttgtagtatagtttgaagtcaggtagcgtgatgcctccagctttgtccttttggcttaggattgacttggcgatgcgggctcttttttggttccatatgaactttaaagtagttttttccaattctgtgaagaaagtcattggtagcttgatggggatggcattgaatctataaattaccttgggcagtatggctgttttcacgatattgattcttcctacccgtgagcatggaatgttcttccatttgtttgtatcctcttttatttcgttgagcagtggtttgtagttctccttgaagaggtccttcacatctcttgtaagttggattcctaggcattttattctctttgaagcaattgtgaatgggagttcactcacgatttggctctctgtttgtctgttattggtgtataagaatgcttgtgatttttgcacattgattttgtatcctgagactttgctgaagttgcctatcagcttaaggagattttgggctgagacaatggggttttctaaatatacaataatgtcatctgcaaacagggacaattggatttcctcttttgctaattgaataccctttatttccttctcctgcctgattgccctggccagaacttccaacactatgttgaataggagtggtgagagagggcatccctgtcttgtaccagttttccaagggaatgcttccagtttttgcccattcagtatgatattggctgtgggtttgtcatagatagctcttattattttgagatacatcccatcaataccgaatttattgagagtttttagcatgaagggctgttgaattttgtcaaaggccttttctgcatctgttgagataatcatatggtttttgtctttggttctgtttgtatgctggattacatttattgatttgtgtctgttgaaccagccttgcatcccagggatgaagccctcttgatcatggtggataagctttttgatgtgctgctggattcggattgccagtattttagtgaggatttttgcatcaatgttcatcagggatattggtctaaaattctctttttttgttgtgtctctgctaggctttggtatcaggatgatgctggcctcataaaatgagttagggaggattccctctttttctattgattggaatagtttcagaaggaatggtaccagctcctccttgtacctctggtagaattcggctgggaatccatctggtcctggactttttttggttggtaagctattaattattgcttcaatttcagagcctgttattggtctattcagagattcaacttcttcctggtttagtcttcggagggtgtatgtgtcgaggaatttatccatttattctagattttctagcttatttgcatagagatgtttatagtattctctgatggtagtttgtatttctgtgggatcggtggtgatatcccagttatcattttttattgcgtctatttgattcttctctcttttcttctttattagccttgctagcaatctatcgattttgttgatcttttcaaaaaaccagctcctggattcattgatttttttgaaggtttttttgagtctctatttccttcagttctgctctgatcttagttatttctcaccttctgctagcttttgaatgtgtttgctcttgcttctctagttcttttaattgtgatgttagggtgtcaattttagatctttcctgctttctcttgtgggcatttagtgctataattttccctctacatactgctttgaatgtgtcccagagattctggtatgtcgtgtctttgttctcattggtttcaaagaacatctttatttctgccttcatttcgttatgtacccagtagtcattcaggagcaggttgttcagtttccaagtagttgagcgattttgagtgagtttcttaatcctgagttctagtttgattgcactgtgttctgagagacagtttgttataatttctgttcttttacatttgctgaggagtgctttagttccaactatgtggtcaattttggaataagtgcggtgtggtgctgagaagaatgtatattctgttgatttggcgtggagaattctgtagatgtctgttaggtctgcttggtgcagagctgagttcaattcctggatattcttgctaactttctgtctcattgatctgtctaatgttgacagtggggtgttaaagtatcccattattattgtgtgggagtctaagtctctttccaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatgagagactaggattgcaacccctgcctttttttgttttccatttgtttggtagatcttcctccatccctttattttgagcctatatgtgtctctgcatgtgagatgggtctcctgaatacagcacactgatgggtcttaactctttatccaatttgccagtctgtgtcttttaattggagcatttagcccatttacatttaaggctaatattgttatgtgtgaatttgatcctgccattatgatgttagctggttattttgcttgttagtggatgcagtttcttcctagcctcaatggtctttacaatttggcatgctttttcagtggctggtaccagttgttcctttccatgtttagtgcttccttcaggagctcttgtagggcaggcctggtggtgacaaaatctctcatcatttgcttgtctataaaggattttatttctccttcatttatgaagcttagtttggctggatattaaattctgggttgaaaattcttttctttaagaatgttgaatattggcccccactctcttctggcttgtagtgtttctgctgagaggtcagctgttagtctgctgggcttccctttgtgggtaacccgacctttctctctggctgcccttaacattttttccttcatttcaactttggtgaatctgacaattatgtgtcttggagttgctcttctggaggagtatctttgtggcattctctgtatttcctgaatttgaatgttggcctgccttgctagattggggaagttctcctgtatgatatcctgcagagtgttttccaacttggttccattctccctgtcactttcaggtacaccaatcagacgtagatttggtcttttcacatactcccatatttcttggaggctttgttcatttctttttattcttttttctctaaacttctcttctcgcttcatttcattcatttgatcttccatcactgatagcctttcttccagttgatctaatcggctactgaggcttatgcatttgtcatgtagttctcgtgccttgtttttcagctccatcaggtcctttaaggacttctccgcattggttattctagttagccattcgtctaattttttttcaaggtttttaacttctttgacatgggtttgaacttccacctttagctctgagtagtttgatcgtctgaagccttcttctctcaactcatcaaagtcattctctgtccaactttgttccattgctggtgaggagctgcgttcctttggaggaagagaggcactctgatttttagaatttccagtttttctgctctgttttttccccatctttgtggttttatctacctttggtctttgatgatggtgacgtacagatggggttttggtgtggatgtcctttctgttttttagttttccttctaacagtcaggaccttcagctgcaggtctgttggagtttgctggaggtccactccagaccccgtttgcctgggtatcagcagcggaggctgcagaacagcggatattggtgaacatcaaatgttgctgcctgatcatgcctctggaagttttgtctcagaggagtacccggccatgtgaggtgtcagtctgcccctactaggaggtgcctcccagttacgctactcgggggtcaaggacgtgcttgaggaggcagtctgtccattctcagatctccagctgcgtgctaggagaacctctactctcttcaaagctgtcagacagggacatttaaatctgcagaggattctgctgccttttgtttggcaatgccctgcccccagaggtggagtctacagaggcaggcaggcctccttgagctgcggtgggctctacccagtttgagcttccaggctgctttgtttacctagtcaagcctcagcaatggcaggcacccctcccccagcctcgctgctgccttgcagtttgatctcagactgctgtgctagcaatgagtgaggctccgtgggcataggaccctccaagccaggcacgggatataatctcttgctgtgccgtttgctaagacagttggaaaagcaccatattggggtgggagtgacttgattttccaggtgccatccatcacccctttctttgactaggaaaggg

SEQ ID NO: 12758 - DNA, 6041 bp, Homo sapiens; identical to SEQ ID NO: 12644

SEQ ID NO: 12759 - DNA, 4726 bp, Homo sapiens
atattttattctcttattttttgtactttaagttctagggtacatgtgcacaatgtgcaggtttgttacatatgtatacacgtgccatgttggtatcctgcacccattaacttgttatttacattaggtatttctcctaatgctatccctccccactaacccactccacgacaaggccctggtgtgtgacattccccttcctgtgtccaagtgttcttattgttcaattccccccatgagtgagaacatgaggtgttttgttttctgtccttgttatggtttgctgagaatgatggtttccagcttcatccatgtccctacaaaggacatgaactcatccttttttatggctgcatagtattccatggtgtatatgtgccacattttcctaatccagtctatcattgatggatatttgggttgttccaagtctttgctattgtgaatagtgccgcaataaacatatgtgtgcatgtgtctttatagtagcataatttataatcctttgggtatatacccagtaatgggattgctgagtcaaatagtatttctagttctagatccttgaggaattatcacactgtcttccacgatggctgaactagtttacagtcccaccaacagtgtaaaagcattcctatttctccacatcctctccagcacctgttgtttcctgactttttaatgatcaccatcctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgtgtgatggggttgtttgattttttcttgtaaatttgtttgagttctttgtagattctggatattagccctttgtcagatgggtagattgcaaaaatttactcccattctgtaggttgcctgttcactctgatggtagtttcttttgctgtgcagaagctctttagtttaattagatcccatttgtttattttggcttttgttgtcattgcttttggtgttttagtcatgaagtccttgtccatacctatgtcctgaatggtattgcctaggttttgttctagggtttttatggttttaggtctaacatttaagtctttcatccatcttgaattaatttttgtataaggtgtaagggagggatccagtttcagctttctacatatggctagccagttttctcagcaccatttattaaatagggaatcctttccccatttcttgtttttgtcaggtttgtcaaagatcaaatggttgtagacgtgtggtattatttctgagggctctattctgttccattggtctatatctctattttggtgccagtaccatgctgtttcagttactgtagccatatagtatagtttgaagtcaggtagcatgatgcctccagctttgttcttttggcttaggattgtcttggcaatgcaggctcttttttggttccatatgaactttaaagtagtcttttccaattctgtgaataaagtcattggtagcttgagggggatggcattgaatctataaattaccttgggcagtagggccattttcatgatattgattcttcctatccatgagcatggaatgttcttccatttgtttgtgtcctcttttattttgttgagcagtggtttgtagttcttcttgaggaggtccttcacatcccttgtaagttggattcctaggtattttattctctttgtagcaattgtgaatgggagttccctcatgatttggctctctgtctgttactgatgtataggaatgcttgtgatttttgcacattgattttgtatcctgagactttgctgaagttgcttatcagcttaaggagattttggactgagacgatggggttttctaaatatacaatcatgtcatctgcaagcagggacaatttgacttcctcttttcctaattgaataccctttatttgtttctcttgcctgattgccctggccagaacttccaacactatgttgaatagaagtggtgagagagggcatccctgtcttgtgccagctttaaaagggaatgcttccagtttttgcccattcaatatgatattggctgtgggtttggcataaacagctcttattattttgagatacgtcccatcaatacctagtttattgagagtttttagcatgaagggctgttgaattttgtcgaaggccttttctgcatctattgagataatcacatggtttttggctttggttctgtttatgtgatggattacatttattgattttcatatgttgaacaagccttgtatcccagggatgaagccaacttgttcttggtggataagctttttgatgtgctgctcgatttggtttgcctgtattttattgaggattttcgcatcgatgttcatcagggatattggtctaaaattctctttttttgtcatgtctctgccaggctttggtatcaggataatgcttgcctcataaaatgagttagggatgagtccctctttttctattgtttggaatagtttcagaagaaatcggactagctcctctttgtacctgtggtagaattctgctgtgaatccgtctggtcctggactttttttggttggtaggctattaattattgcctcaatttcagagcctgttattggtctattcagggattcaacttcttcccagtttaatcttaggagagtgtatgtgtccaggaatttatccatttcttctagattttctagtttatttgcatagaggtgtttatagtattctctgatggtagtttgcatttctgtgggatcggtggtgatatcccctttatcatttttcattgcatctgtttgattagtctctattttcttctttattagtcttgctggtgatgtatcaattttgttgatcttttcaaaaaagccagcgcctggattcattgattttttgaatggttttttgtgtttctgtctccttcagttctgctctgatcttagttatttcttgccttctgctagcttttgaatgtgtttgctcttgcttctctagttcttttcattgtgatgttaggatgtcgattttagatctttcctgctttcccttgtgggcatttagtgctataaatttccctctacacactgctttaaatgcgtcccagagattctggtatgttgtgtctttgttctcattggtttcaaagaacatctttatttctgccttcattttgttatttacccagtagtcattcaggagtaagttgttcagtttccatggtagttgtgcagttttgaatgaggttcttaatcctgagttctaatttgattgcactgtggtttgagagacagtttgttgtgatttctgttcttttacatttgctgaggagtgctttacttccaactttgtggtcaattttggaataagtgtgatttggtgtctaatgatgactttctgtttatttggggtggtattgtctgtagatgtctattaagatctccttggtccagagctgagttcaagtcctggatatccttgttaaccttctgtctcattgatctgtctaatattgacagtggggtgttaaagtctcccattattattgtgtgggagtctaagtcttttttttgtctctaaggacttgctttatgaatgtgggtgctcctgtattgggtgcatatatatttaggatagttagctcttcttgttgaattgacccctttaccattatgtaatggccttctttgtctttgttgatctttgttggtttaaagtctgttttatcagagactaggattgcaactgctgcttttttttttgctttacatttgcttggtagatcttcctccatccctttattttgagcctgtgtgcgtctctgcatgtgagattggtctcctgaatacagcacacttgatgggtcttgactctttatccaatttgccagtctgtgtctaatttaattggggcatttagcccatttacatttaaggttaatattgttatgtgtgaatttgatcctgtcatgatgttagctggttattttgcccattagttgatgcagtttcttcctagcatcgatggtctttacaatttggcatgattttgcagtggctggtaccagttgttcctttccatgtttagcgcttccttcaggagctcttgtaaggcaggcctggtggtgacaaaatctctcagcatttgcttgtctgcaaaggattttatttctccttcaattatgaagcttagtttggctggatatgaaattctaggttgaaaattcttttctttaagaatgataaatattggcccccactctcttctggcttgtagagtttctgccaagagatctgctgttagtctgatgggattccctttgcgggtaacccgacctttctctctggctgcccttaacattttttccttcatttcaaccttggtgaatctgacaattatgtgtcttgggattgtttttctcgaggagtatctttgtggtgttctctgtatttcctgaatttgaatgttggcctgccttactaggttggggaagttctcctggataatatcctgaagagtgttttccaacttggttccattctccccgtcagtgtcaggtacaccaatcagacgtagatttggtcttttcacatagtcccatatttcttggaggctttgtttgtttctttttagccttttttct

SEQ ID NO: 12760 - DNA, 9663 bp, Homo sapiens
cggtttttttttttttttttttttttttttttttttttggtaaacatagggtctcgccatgttgcctaggccatacttgaactcctgggctcaaccaatcctcccaccttggcctttcaaagtgctaggattatagtactgtaagccaccacacacagccccagctgggattttgattgggattgctttgaatctatagatcaatttgggaaaactgatatatcctaacaatattgagttttctaacacatgaacatggcatatatctgcatttatttagacctttaaaaatttctttcagccatgtttcaaggttttgtggctttcagtgcagaggtcttatacatctttcattatagattactaggcatttgatggattttgatgctatcaaaaattgtattttaaaggtcactttccaataatttcttgctagtatacagaaatataattaattatttatatataaacctgtatccaacaaccatatcaatttactttttttttttttttttttgacagagtctcgttctgtcgcccaggctggagtgtggtggcgtgatctcagctcactgcaaccctcacttcctgggttcaagcaattcttctacctcagcctcccgagtagctgggactacaggcacgtgccaccatgcccagctgatttttgtatttttagtagagacggggtttcaccatattggccaggctggtctcgaactcctgacttcatgatccacctgccttggcctcccaaagtgctgagattacaggtgtgagccaccgtgcccagcccaaatttacttatttttaaaactttattccaaatcacagataaagaaaaccatattatatgcatgtctatttgcatatacataatacatactatatatacacacacatacatacagttgttataatgtttgttttgaaaatgtgaatttgttccaacatgattgatatattaggtaacaattaatgtaaattatgtaaattaagtacttgcttatgtgcaatttagtctatgtgaaatagtaagtgaatgcagaaagcagcatctggctgaaccaagctgtataggaatatgcataacacacacatgtgcacaactcaaacttctatccactacctcagttcactgaatgtgttatgggccacactcatccacatctgttgctacaactttccatcagatttcagacaacctcctcccaccacttcacagtatctcacaagctgcagtccttctgatattcacttccataagcaaatgccaggtcttttttaaggtaaatagccatatttattgtagtattcatgtatttttagtcatttaacatatataaaaccatgctgtcattttattaggctcttatcttttttttaatatgtcacagaccaaattttttagtgttataccccaaccccattttttcccgtaagccctgtggtctttattacacaattttggatactgtaataatttttaggcatgcatatgccatgtaacagcaaaactgactaaatatgtaaagtattttcattattgctaatccatatccacgtgaaaaaagttaccaactagaatacagtattgtgcatagttctttttgtctttagccttgcatctaatcaaaacagagtttttcaaagttacttaaatcggcttctttcttcctcacccccttccatgtggctatgtagttcattcgtaatagagtcagattcatttgtcacagtctgaattccatctgggattccctccacatcctgattgatttattttaaaattgtatccggtaaaatctactctttgtggcatatagttctattggttgtgaaaaatgcatagaattgtgtgtccactatcactgctccttatagaacattcattaccctaaagattctctcatgttacccctttatagggaactcctactccaatgtccaacctctggcaatcactgatgtgttttcttttcctatggttttaccttttccaggatatcatataaatggaatcatagccttttggatctgtcttttttcacttggcaaatgcatttaacattcatttacttctgagtagtattccattatagagatgtacagtttgtttatctatttcaggttacatttgttgttggaattatgttgtaagctcctggaaatggtagattggctgggtctctgcagtgttttcaaagtcatggtttagaaattgctccattattctgagttcttcggataggcgaaatgcccttctaatgcatacacagggcaggggttattaaccccactttccagatgagaagattatggctgagaaactaaatgctgttcctacccatagaaacagcaaattaatggagagccaggaccctaatcccacatgttctgattcacaatccactactggaaaacatgtaaaggagaagaatggctatgactagaaggttggaaaatagaacctatttctgaaatagttgatctgaagaagacagagcttaacaaatgctttggaaaccgtcttaaagcatataaagggtttacaactgaagttaaaaaagaacatattgtctttaagaggcagcatggagagagtgatcaattagacctaagatgtgaaatgggttactaggaggcctggaattattccagtataatattgaatggaagtggtgatagtgtatatccatgtttcattccctgacatcagtgagaaagtgttcatattttaccattaaatacaaaataaggagtagtttgttttcaagtaatgtttatcagattgaggaagtgactttctattcctagttcgttgagtgttctcgtcatgaatgggtatggaatttttttcaaatgctttttctgcatctattgagattattatattttcctcttttattttgttaatgtgcactcatttttgaatgttgaattcctgggataagcaatattggtcatgatgcagtatcctttttatatattgctggattcaattttctaaaatgtatttaggatctttgcatctatcatttaagatactggcctgatgccgggtgtggtggtccacgcctgtaatcccagcactttgggaggccgaggcgggcggatcacctgaggtcaggagttcaagaccagccttgccaacatggtgaaaccccatctctactaaaaatacaaaaattagctgggcgtggtggtgcatgcctgtagtcccagctacttgggaggctgaggctggagaatcgctggaacctgggaggcaaatattgcagtaagctgagatcgtgccactgcgctccagcctgggcgacagagtgagacttcatctcaaaaaaacaaaaacaaaaacaaacaaacaaaaaagacactgacactgacttgtatttttctttttagtttttggaatcagagtatgctggcctcataaaatccatgtattacttttttctctattttccataagagatatttgtatgagattgatattatttctttctttttattttattttattattataatactttaagttttagggtacatgtgcacaatgtgcaggttagttacatatgtatacatgtgccatgatggtgtgctgcacccattaactcgtcatttagcattaggtatatctcctaaagctatccctcgcccctccccccaccccacaacagtccccagagtgtgatgttccccttcctgtgtccatgtattctcatcgttcaattcccacctattagggagaacatacagtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaggtctttcctattgtgaatagtgccacaataaacatacgtgtgcatgtgtctttatagcagcatgatttatagtcctttgggtatatacccagtaatgggattgctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcaatgtgtttattggctgcataaatgtcttcttttgagaagtgtctgttcatgtccttcacccactttttgatggggtttttttttttcttgtaaatttgtttgagttctttgtagattctggatattagccctttgtcagatgagtaggttgtgaaaattttctcccattttgtaggttgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcctctagagtttttacggttttaggtctaacgtttaagtctttaatccatcgtgaattgatttttgtataaggggtaaggaagggatccagtttcagctttctacatatggctagccagttttcccagcaccatttattaaatagggaatcctttccccattgcttgtttttctcaggtttgtcaaagatcagatagttgtagatatgcggctttatttctgagggctctgttctgttccattgatctatatctctgttttggtaccagtaccatgctgttttggttactgtagccttgtagtatagtttgaagtcaggtagcttgatgcctccaactttgttcttttggcttaggattgacttggagatgcaggctcttttttggttccatatgaactttaaagtagttttttccaattctgtgaagaaagtcattggtagcttgatggggatggcattgaatctataaattaccttgggcagtatggccattttcacgatattgattcctcctacccatgagcatggaatgttcttccatttgtttgtatcctcttttatttccttgagcagtggtttgtagttctccttgaagaggtccttcacatcccttgtaagttggattcttaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctctcttgtgccagttttcaaagggaatgcttccgtttttgcccattcagtatgatattggctgtgggtttgtcatagatagctcttattattttgaaatacatcccatcaatacctaatttattgagaatttttagcatgaagggttgttgaattttgtcaatggccttttctgcatctattgagataatcatgtggtttttgtctttggttctgtttatatgctggattacatttattgatttgcatatattgaaccagccttgcatcctagggatgaagcccacttgatcatggtggataagctttttgatgtgctactggattcggattgccagtattttattgaggatttttgcatcaatgttcttcaaggatattggtctaaaattctcttttttggttgtgtctctgcccggctttggtatcagaatgatgctggcctcataaagtgagttagggaggattccctctttttctactgattggaatagtttcagaaggaatggtaccggttcctccttgtacctctggtagaattcggctgtgaatccatctggtcctgggctctttttggttggtaagctattgattattgccacaatttcagagcctgttattggtctattcagtgattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctcttttcttccttattagtcttgctagaggtctatcaattttgttgatgctttcagaaaaccagctcctggattcatgaattttttgaaggggtttttgcgtctctatttccttcagttctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacatactgttttgaatgcatcccagagattctggtatgttgtgtctttgttctcgttggtttcaaagaacatctttatttctgccttcgttttgttatgtacccagtagtcattcaggagcaggttgttcagtttccgtgtagttgagcagttttgagtgagtttcttaatcctgagttctagtttgattgcactgtgatctgagagacagtttgttataatgtttgttcttttacatttgctgaggagagctttacttccaagtatgtggtcaattttggaataggtgtggtgtggtgcagaaaaaaatgtatattctgttgatttggggtgaagagttctgtagatgtctattaggtccacttggtgcagagctgagttcaattcctgggtatccttgttaactttctgtctcgttgaactgtctaatatttacagaggggtgttaaagtctcccattattattgtgtgggagtctaagtctctttgtaggtcactcaggagttgctttatgaatcagagtgctcctgtattgggtgcatatatatttaggatagttagctcttcttgttgaattgatccctttaccattatgtaatggccttctttgtctcttttgatctttgttggtttaaagtctgtttgatcagagaataggatcgcaacccctgcctttgtttgttttccatttgcttggtagatcttcctccatccttttattttgagcctatgtgtgtctctgcatgtgagatgggtttcctgaatacagcacattgatgggtcttgactctttatccaatttgccagtctgtgtcttttaattggagcatttagtccatttacaattaaagttaatattgttatgtgtgaatttgatcctgtcattatgatgttagctggttattttgctcgttagttgatgcagtttcttcctagtctcgatggtctttacattttggcatgattttgccgtggctggtcccagttgttcctttccatgtttagtgcttccttcgggagctcttttagggcaggcctggtggtgacaaaatctctcagcatttgcttgtctgtaaagtattttatttctccttcacttatgaagcttagtttggctggacatgaaattctgcattgaaaattcttttctttaagaatgttgaatattggcccccactctcttctggcttttagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgttagattggggaagttctcctggataatatcctacagagtgttttccaacttggttccattctccccgtcaccttcaggtacaccaatcagatgcagatttggtcttttcacatagtcccatatttcttggaggctttgttcatttctttttattctttcttctctaaacttcccttcttgcttcatttcattcatttcatcttccatcactgacaccctttcttccagttgatcgcatcggctcctgaggcttctgcattcttcacgtagttcttgagccttggctttcagctccatcagctcctttaagcacttctctgtattggttattctagttatatattcgtctaaatttttttcaaagttttcaacttctttgcctttggtttgaatttcctcctgtagctcagagtagtttgattgtctgaagccttcttctctcacctcgtcaaagtccttctccgtccagctttgttccgttgctggtaaggagctgcgttcctttggaggaggagagacgctctgatttttagagtttccagtttttctgctctgttttttccccatctttgtggttttatctacttttggtctttgatgatggtgatgtacagatgggtttttagtgtggatgtcctttctgtttgttagctttccttctaacagacaggaccctcagctgcaggtctgttggagtttgctagaggtccactccagaccctgtttgcctgggtaccagcagcggtggctgcagaacagcggattttcgtgaaccgcaaatgctgctgtctgatcgttccgctggaagttttgtctcagaggagtacccagctgtgtgaggtgtcagtctgcccctactggggggtgcctcccagttaggctgctcgggggtcggtgtcagggacccacttgaggaggcagtctgctgattctcagatctccagctgtgtgctgggagaaccactgctctcttcaaagctgtcagacagggacatttaagtctgcagaggttattgctgtctttgtttgtctgtgccctgcccccagaggtggagcctacagaggcaggcaggcttcctcgagctgtggtgggctccacccagttcaagcttccaggctgctttgtttacctaagcaagcctgggcaatggcaggcacccctcccccggcctcgctgccgccttgcagtttgatctcagactgctgtgctatcaatcagtgagactctgtgggcataggaccctacgagccaggtgcgggatataatctcctggtgcgccattttttaagcccgtcagaaaagcgcagtattggggtgggagtgacccgattttccaggtgccgtctgtcacccctttctttgactaggaaagggaactccctgaaaccttgcacttcccaagtgacgcaatgcctcgccctgcttcagctcactcacggtgcgctgcacccactgtcctgcgcccactgtctggcactccctaatgagatgaacccggtacctcagatggaaatgcagaaatcacccgtcttctgcgtcgctcacgctgggagctgtagaccagagctgttcctatttggccatcttggctcc

SEQ ID NO: 12761 - DNA, 5774 bp, Homo sapiens
tttttctttattattattattattattattattattattatactttaagttgtagggtacatgtgcacaatgtgctggttagttacatatgtatacacgtgccatgctggtgcgctgcacccactaactcatcatctagcattaggtatacctcccaatgctatgcctcccccctccccccacccaacaacagtcctcagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttttttatggctgcatagtattccatggtgtatatgtgccacattttcttaatccagtctatcattgttggacatttgggttggttccaagtctttgctattgtgaataatgctgcaataaacatacctgtgcatgtgtctttatagcagcatgatttatagtcctttgggtatatacccagtaatgggatggctgggtcaaattgtatttgtagttctagatccctgaggaatcaccacactgacttccacaatggttgaactagtttacagtcccaccaacagcgtaaaagtgttcctatttctccacatcctctccagcacctgttttttcctgactttttaatgatcgccattctaactggtgtgagatggtatctcattgtggttttgatttgcatttctctgatggccagtgatggcgagcattttttcatgtgttttttggctgcataaatgtcttcttttgagaagtgtctgttcatgtccttcacccactttttgaaggggttgtttgtttttttcttgtaaatttgttggagttcattgtagattctggatattagccctttgtcaggtgagcaggttgcgaaaattttctcccattttgtaggttgcctgttcactctgatggtggtttcttttgctgtgcagaagctctttagtttaattagatcccatttgtcaattttggcttttgttgccattgcttttggtgttttagagatgaagtcctcgcccatgcctatgtcctgaatggtaatgcctgggttttcttctagggtttttatggttttaggtctaacgtttaagtctttaatccatcttgaattgatttttgtataaggtgtaaggaagggatccagtttcagctttctatagatggctagccagttttcccagcaccatttattaaatagggaatcctttccccatttcttgtttttgtcaggtttgtcaaagatcagatagttgtagatatgcggcattacttctgagggctctgttctgttccattggtctatatctctgttttggtacgagtaccatgctgttttggttactgtagccttgtagtatagtttgaagtcaggtagtgtgatgcctccagctttgttcttttggcttaggattgacttggtgatgcgggctcttttttggttccatatgaactttaaagtagtttttttctaattctgtaaagaaagtcattggtagcttgatggggatggcattgaatctataaattaccttgggcaatatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaaactttgctgaagttgcttatcagcttaaggagatttggggctgaaacaatggggttttctagatatacaatcatgtcatctgcaaacagggacaatttgacttcctcttttcctaattgaataccctttatttccttctctgcctgattgccctggccagaacttccaacactatgttgaataggagtggtgagagagggcatccctgtcttgtgccagttttcaaagtaatacttccagtttttgcccattcagtatgatattggctgtgggtttgtcataaatagctcttattgttttgaaatacgtcccatcaatacctaatttattgagagtttttagcatgaagggttgtggagttttgtcaaaagccttttctgcatctattgagataatcatgtggtttttgtctttggttctgtttatatactggattacatttattgatttgcgtatattgaaccagccttgcatcccagggatgaagcctacttgatcatggtggataagctttttgatgtgctgctggatttggtttgccaatattttattgaggatttttgcatcaatgttcatcaaggatattggtctaaaattctcttttttggttgtgtctctgcctggctttggcatcaggatgatgctggcctcataaaatgagttagggaggattctctctttttctgttgattggaatattttcagaaggaatggtaccagttcctccttttacctctggtagaatttggctgtgaatgcatctggtcctggactctttttggttggtaagctattgattattgccacaatttcagatcctgttattggtctattcagagattcaacttcttcctggtttagtcttgggaaagtgtatgtgttgaggaatttatccatttcttctagattttctagtttatttgcgtagaggtgtttgtagtattctctgatggtagtttatatttctgtgggattggtggtgatatcccctttatcattttttattgtgtctatttgattcttctctctttttttctttattagtcttgctagcggtctatcgattttgttgatcctttcaaaaaaccagctcctggattcattgattttttgaagggttttttgtatctctacttccttcagttctgctctgattttagttatttcttgccttctgctagcttttgaatgtgtttgctcttgcttttctagttcttttaattgtgatgttagggtgtcaattttgaatctttcctgctttctcttgtgggcatttagtgctataaatttccctctacacactgctttgaatgggtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataattactttctttttacatttgctgaggagtgctttacttccaagtatgtggtcaattttggaataggtgtggtgtggtgctgaaaaaaatgtatattctgttgatttggggtggagagttctgtagatgtctattaggtccgcttggtgcagagctgagttcagttcctggatatccttgttaactttctgtctcattgatctgtctaatgttgacagtggggtgttaaagtctcccattattaatgtgtgggagtctaagtctcttggtaggtccctaaggacttgctttatgaatctgggtgctcttgtattgggtgcatatatatttaggatagttagctctttttgtttaattgatccctttaccattatgtaatggccttctttgtctcttttgatctttgttggtttaaagtctgttttatcagagactaggattgcaacccctgccttttttgttttccattttcttggtagatcttcctccatccttttattttgagcctatgtgtgtctctgcacgtgagatgggtttcctgaatacagcgcactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccggttgttcctttccatgtttagcgcttccttcaggagctctttcagggcaggcctggtggtgacaaaatctctcagcatttgcttgtctgtaaggtattttatttctccttcacttatgaagcttagtttggctggatatgaaattctggattgaaaattcttttctttaagaatgttgaatattggcccccactctcttctggcttgcagagtttctcccaagagatccgctgttagtctgatgggcttccctttgagggtaactcgacctttctctctggctgcccttaacattttttccttcatttcaactttggtgaatctgacaattatgtgtcttggagttgctcttctcgagaagtatctttgtggcgttctctgtatttcctgaatctgaatattagcctgccttgctagattggggaagttctcctggataatatcctgcagagtgttttccaacttgtttccattctcccgtcactttcaggtacaccaatcagacatagatttggtcttttcacatagtcccatatttcttggaggctttgctcgtttctttttattcttttttctctaaacttcccttcttgcttcatttcattcatctcatcttccatcactgataccctttcttccagttcatcgcatcggctcctgaggcttctgcattcttcacgtagttcttgagccttggttttcagctccatcaactcctttaagcacttctctgtattggttattctagttatacattcttctaaatgtttttcaaagttttcaacttctttgcctttggtttgaatgtcctcccgtagctcagaataatttgatcgtcagaagccttctctcagctcgtcaaagtcattctctgtccagctttgttccgttgctggtgaggaactgcgttcctcagatggaaatgcagaaatcacccatcttctgtgtcgctcacgctgggagctgtagaccgaagctgttcctattcggccgtcttggctcctccctcaaatgtctggatctcgcttctctagttcttttaattgtgatgttagggtgacgattttagatctttcctgctttttcctgtgggcatttagtgctataaatttccctctacacactgccttagctgtgtcccagagattctggtacattgtgtctttgttctcattggtttaaaagaacttactttttttgccttaatttcgttatttacccagtggtcattcaggagcacattgttcatcttccatgtagttgtgtggttttgagtgagtttctaatcttgagttctaatttgattgaactgtttctgagagactgtttgctatgatttccattctttttcatttgctgaggagcgttttacttccaaattatgtggtcgattttagaataagtgctatatgttgctgagaagaatgtatattctgttgacttgaggcagagagttctgtagatgtctattaggtctgcctgctccagagctgaattcaaatcctgaatatgcttgttaattttctgtctcattgatctgtctaatattgacagtggggtgttaaagtctcccactattattgtgtgggagtctaagtctctttgta

SEQ ID NO: 12762 - DNA, 28257 bp, Homo sapiens
  misc_feature (10735)..(10735): n equals a,t,g, or c
gtttctttttttaaatttaattttattattattatactttaagttttagggtacatgtgcacaatgtgcaggttagttacatatgtatacatgtgtcatgctggtgtgctgcacccattaactcgtcatttagcattaggtgtatctcctaatgctgtccctccccccttcccctaccccacaacagtccccagagtgtgatgttccccttcctgtgtccatgtgttctcattgttcaattcccacctatgagtgagaacatgcagtgtttggttttttgtccttgcgatagtttactgagaatgatgatttccaatttcatccatgtccctacaaaggacacgaactcatcattttttatggctgcatagtattccatggtgtatatgtgccacattttcttaatccagtctatcattgttggacatttgggttggttccaagtctttgctactgtgaatagtgctgcaataaacatacgtgtgcatgtgtctttatagcagcatgatttatagtcctttgggtatatacctagtaatgggatggtcaaatggtatttctagttctagatccctgaggaattgccacactgacttccacaatggttgaactagtttacagtcccaccaacagtgtaaaagtgttcctatttctccacatcctctccagcacctattgtttcctgactttttaatgattgccattctaactggtgtgagatggtatctcattgtgggtttgatttgcatttctctgatggccagtgatggtgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggctgtgaaaatgttctcccattttgtaggttgcctgttcactctgatggtagtttcttttgctgtgcagaagctctttagtttaattagatccatttgtcaattctggcttttgttgccattgcttttggtgttttagacatgaagtccttgcccatgcctatgtcttgaatggtaatgcctaggtttttttctagggtttttatggttttaggtctaacgtttaagtctttaatccatcttgaattaatttttgtataaggtgtaaggaagtgatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggtttaggactgacttggcgatgcaggctcttttttggttccatatgaactttaaggtagttttttccaattctgtgaagaaagtctttggtagcttgatggggaaggcattgaatatataaattaccttgggcagtatggccattttcatgatatcgattcttcctacccatgagcatggaatgttcttccatttgtttgtatcctcttttatttcattgagcagtggtttctagttcttgaagaggtccttcacgtcccttgtaagttggattcctaagtattttattctctttgaagcaattgtgaatgggagttcactcatgatttggctctctgtttgtctgttattggtgtataagaatgcctgtgatttttgtacattgattttgctcctaatcatgtttctaatatgacaaactgatggatacttcactgctctcttcttattctatttctcaacagtatttatcatgatcatcaatcaatctggacctgaagccctcaactcgcctggcttctgaaactccacactcttggttttctttctattcctctgatcctgcctctactgggtctttcttctctaccctttcttggcttaatctggagcctctttccttttctcttgtttcctggcacagcttcattaagcaatctcatctagttccatggattaaaatggtctctttatgctgatgactactagactccaagaattatcctctgtcttgaccagtggttcttaaagtgggaaccctggaccagtagcatcagcatcacctggaaacttgttagaactgcaaattctctgactccacccagcccttcttaatcagaaactctgaaggtagggcccagcagtctgtatgttaacgagctctccagctgattgtgatgcacattgaagttgaagaacaactgctctagactaacatatttaatggcctcatttccatctctccttgtatgtctcacggaaatataaatcttcacacatccagtttcatgtcttttttctctctcaacttcctcagcccacatctaatccattagtaaatattgctaattctatctccaatttatataaaaaagtaccagtttctccacaattctatcaccaccactataattagaagcaccatcttactttttcatgcaagaccaatgcaacattttctacttattcccaacttgtccccctccaaccccaatctccatactgcaagcaagcaaggtcttttaaaaatgtaatttggctcctccatcctaaaacactctaagtggttttcccttagacctagaataggatccaaactccataccatggtctccaaggccctacccgatttgagtcaggtccattcctccattacttcacctagtggcagcctctccctctcctactgcatcccagatgcactggttttctctcttagttccctggagaagccagctgctttctgcctcagagactatgcccttttctttggaactttccttctcatcctgtgaatggctggctcagccgctcagccccgcagtctcagcttaaatgtcacttccttttatgtgctttttaccacctatattttcctccacaacccactattctcaatcatcacctttttatttccttcctagcatgtccacaatttggaatattttctttttttttttttttgaggcagagtctcactctgtcatccagactggagtgcaatggcgcgatgtctgctcactgcaacttctgtctcccaggctcaagtgactctcctgcctcagcctcccaagtagctgggattacaggcatgtgccaccatgctcggctaatttttgtatttttagtagagggagggtttcaccatgctggtcaggctggtctcgaactcctcacctcaaatgatccacccacctcggcctcccaaagtgctgggattacaagcgtgagccactgcacccagcccacaacttataaatgttctattcagtcacctactcacttgatgttggttttattttgtttgtctctgttcttctcttcctaccacactgaatgtgaactcatgagagaaggagactcatatatctccatcactgtcagtgtctggcacagtggcgggcacagggtaggtagttgttgatgtaatcactcttattagcatgtgaaaaggaggtgggggagacaccctgtcaggccttttggagctcctaggtgctggatcctaaatcacaagaagtcaaagcctcacttaagttttgtgttcctgtgtgcacagccctgagctaataggaggcaaccactgtccgcaaggagcatcccttctagatgggaacacaaggtgagacatacatgcgtgcaaacactggagagcaagtgaagacagacacaatcagaggtaagactaattggtccaaaatctaaatatcatgggaattttggggcaggaccgataacagggcactaggataggtgagaaaaatgagaaattggcaatagggcaatttcctcatgtgagctcctcatgggcatgagatatgtctttttgttattctgttaaatacctgttttgttttgcttaagggcataacttcaagtagataaagaatgtgtccatccctaaggaaatcagggccaccagtctagctaggaagcctcctttctttttctaaggaaacagtctgcaagcagcatagtcagctgtgaggatgagggcaaggacagcattgtgtataacacagtgtagcctttttactcaggtggctaatgcaatccacagaagaacttaaaagattcagaaatgacaaagctagcttatgacaaaaacagtcaagaactttcctcgcttcctctccttcttccccctgtttgggccctacatagcaatctgaaagagaagggagaatactacacaggtaagagggaaagggacatgatcgcttttcaccagaagggccagcctaaagcagaactcactgggagagaagagacgacttaccaggacacatgttcaaagtttgattcttacataggactggacaattaattacttaactaattaatagagggtgtgattatgacataaagtgactgtaggatttttgtttcctaagctaatggtgaagtaatgggacctacttgaatttttatccagaatgtgggagtggggctagctctgatgaatgaatgttaaaactttatgtgtcctgcttgagtaaaatactaaagaatgaaaaaataacaaatatatgaatgaataaaccaaagcacaaaaatcccacaggtgaagatgtctaagatggtggagacaattccagatgctggatcttccctcttgtctgttctacctgctaaaggagctcagaggtaaagccaggggaacacctaagaagagcatggatttattttattaattatttagccaaaagctatgatggtagaacaacttttgaagtaaagaagccaggtaactataacaacaaccctcttcttcaatattccagtccaactacccttccaagagatgacctggagtcagtagtttggcctataagcttctagtgcttcactatacttttatacacatatatagacatgaagccacatatattatggagtgtgtttgcatttttaatgggttcataatacatgttattcaatatttgttttcactgaacatgtgttttgcttttcactgaatgtacattattccacaacagtgatggctcataatttagccaaccacaattctactgatagacatttaagttgtgtttaatttttaccaatgtgatgccatgggatttttaacatatctttttacatgtgcaaacatttcttcaacacagatttctaaaaatgaaagttttagatcagagatttaaatgtatgtattttaacttttattttatagagatgggggtctcactatattgcccaggagggatggtcttgaactcctgaactcaagcaatcctcccaccttggcctcccaaagtgctggaattacaggcatgagccactgcacctggccttattttggatttagatggatacctatcaagactgactgagggtttcactcccccacacacttgctaatgctggatattaacaagctataaattttttccaatctcctgagtagaaactgataactcagtgttgtttttatttgtattcccctcactaggagcaaggctgaccatcttttcatgtttgtggaccatttgtacttttcagctgttcatattctttacccatttttccattggattgttcatcttttaaacatcatgggtaggatgtttttatgttggatactagttgtgagttacatgcttgacaaatgttttttcccagcttatcatttacgctttctttttaacttttaagacagcatcttttattgaggagaaatgtatgtggaaaaaagtgatattttttcctttatgtattatagattttgtatgctgcttaagaagaccttaccccaatgaaatatttcctcatctttccatctaatactcttgcaattttgtttttcaagttgaagtttttaattcatttgaaatttatcgtagtataaagtaggtatctgtatttttccaaaaacttccaacaccatttattgatagttcacacttttctgtctggttagaaatgccatttttattataaaccaaattgcaattcatgtattagtctgtttgaagaatttctgttctgttcaattgataactttatataggagctaacagcgcattaattactacagctttttagaatactttgatgttggataggtcaagttccatttcatttatcttcactcatttaaaaaaatctggtatgttgagaatcaggttttcaaatttcataaaaatgagaatttcatcaactttcttaatttgggaatgatatgagagctttacagtgttaagccttcccacccagaagacttccacaatttccatctttacttattgagatcttttatgtctttgggtagagttctcaagtattctttatataggttttgcacatttcttaacaggtttactgctggtattttatagtttatgctgccattgctattacatttcttaactgctggtgtagagattctacaaatatcttgtatccagacattttattacacactcctttaactgattcttttgcttctctaggcagaattcattagtatgactgatattttgacttcagagtgaaagatgcgagagatatgcagatgatctttaagtatctataagattctgtgtacaaccagagagaaagactacgtaaataattcagaattcaatcaggcagtaaagagattagttgaacagagttatcagctacctcagtggaaggctgtagacttaaatcagatggaagaattgggtaacttgtaatttgaacccaggagaaatgaaccccatttgaagggtttatacttggagtccctgttgtcacggcaactatgaaaggagctcatagtttctattgctgacaaggggagaatcatgctggatatacagctcccaggttcagatttcttaacctctggtctctcaagatgataaaacccagcttgctagcagtggtaaaactgtactctttgcaagtagtatgtttccaatctcatagaattttagaatgtaatatattctaaagaaaataaaactaatattattgatacttgtgtgttacatttaggataatttaggtcaatctggattctacattgacatattaggctatttggcagattagccttgtgatttcaatttggaatgtgtatgaataattgaattttagaatgagagctttattttgagatgtgtaagataatttgaccaaatctgaaaatagtattagaatgtttaaataaggtgagctacactatatttataggtttaacttactagatttgtaagaattgtgaaagtaacagaaagggttttcttattaagataggcattttttaaggctttgaagaaaattaaatttttaaaatttataagtggattttatttcctttaagagaatataagttgtaaatagggctagtttttaaagagtttagtctataaaacttaagttactcaaataattttttacaaagtaaaatgattgttcttattttctacacatataaaaagaaaacaaagatttgtaagttgcacttaacggcttggagagaattaaattttaaaatttttcgccataataaattgatattcatttttaaatacattgtttctctgtacacaaattattttcgctgtacagagattatttccttagattgtctaggtagatgatcatttcatatgaaataatgtcagttttgtcattgatatgtcatttatgccttttgtcagttttgtcatttatactttttacacctgcttcttgtttgtacactggccaaaacctgagtggtaatggtggctgtccatgttttattcctgattatggtaatatttcaccattaagtatgaggtatgctatcagttcttgaatataagttttgcctcatcaaagatatttttctatttctagtttaaacaacttttaaaatcataaacaaatattgattttgaaatacacttttttcagcctctgttgaaaagaccaaaatctttttcactttaatctgctaacagagaattacattaatacattttctcatactgaaactttagtaaagtaaatcctaacaggtcataatatattaacataccattgaattttacttggaaattaaaattttttttacatttatgttcataaatgaaatcagtctataattgtatcatatgttatctctggatttttctttttcatttttaatgaactttatttttcagagtgggctaaggttcacagcaaaattgagcagaaagtacagagagtttccatgtactctctgtctgcacatatgcacaacctcccctacgactgacaccttgcaccacagtggtacatttgttacaatcagtgaacctaggttgacatgtaactgtcacgcaaagtccatagtttacattagggtttactcttggtgttgtacattctatggattttgacaactgtataatgacatgtatccaccattgtagtatcatacagaatagtttcactgttctaaaattccgtgctctgcctactaatccctccctcccctctaacgcctggcaatcattaatctttttactgtctctgtacttttgtgttttccagaatgtcatatagtagaatgatacagtatgtagcccttccatattgacttctttcacttagtaatatacacttaagtttcctccatatcttttcatggcttgatagctcatttctttttagtgctgaataatattcaattgtccgaatgttccacagtttttttaatccattcacctactgaaggacatcttggttgtttccaagttttggcaattatgtataaggctgttataaacatctatgtttaggtttttctaaacatgttttcaattcatttgggtaaataccaaggagtaaaattactggatcatatgataagagtacgtttagttttctgagaaactgccaaactatctttcagagtggctatagcatttttcattcccaactgcaatgaatgagagttcctgttgctccatattcttggcagcatttggtgttgtcagtgttttggattcagaccattctaatgggtatgtagtggtatctcattattgttttaactagcaattctctagtgacacatgctgttgagcatcttttcatacgcttgcttgccatctgtctatcttctttggtgggatatctattcgggtcttttgcccattttttaattgggttgtttgtgttcttattgttgagtttttgttttattttgttttttttgagacggagttttgctcttgtcacccaggctggggtgtaatggtgcaatctcagctcactgcaacctccacctcctgggttcaagtgattatctagccttgcctcttgagtagctgggattacaggcatgtgccaccatgcccagctaatttttgtatttttagtagagatgaggtttcatcatgttggccaggctggtcttgaactcctgacgtaaggtgatccacccgcctcagcctcccaagggattacaggcatgagccaccacacccagcttattgttgagttttaagagtgctttgtatatttcagataacaaaccattaacagatgtgtcttttgcaaatgtattctccctgtctatggcttgtcatttcattctcttgacactgtcttccccagagaaaaaggatttaattttaatgaagcttagcttattaattatttctttcatggatcatgctttaggcgtatgaaaaagatcattgctatatccaaggtcatccaaattttctcctgtattatcttctaggagctttatagttttgcattttatattcaggtctatgatccgttttgagttaattcttataaggggtataaggtgtattctagattcttttttttgagggggggatgtccagttcttccagcattgtatgtagaaaagactttcactgcttcattgtattggcttcattcttttgtcaaaaatcagtttacaatatttatgtgggtgagggtctatttctggcctctctattttgttccattgatctatttggctatttttttcactaataccacaccctcttgattaatgtagctttataagaagttttgaattcaagtaatgtcagtcctccaactttataattctatttcaatattatgttggctattctgggtcttttgcctcttgatataaatattataatcagtttttcaatacccagaaaataacttgctgggattttgaccaggattgtgttgaatccagagatcaagttgggaagaacagacattttgacaatattgactctttctatccataaaatatggaatatttctccattcatttagttctttgctatcttttatcagaattttttagttttcttcatacagatcttgtacatactttgttagatttacaccttagtattcccttttttgagggtgctactagagatgataatgtgttgttaattccaaactccacttgtttattgctgtatatagaaaagcaattgacttttatatattagccttgtaccctgcaaccttgtaataatcacttattagttccagaaggtggtggtggttgtggcagcggtggtggtggcancggtggtggtggtggtggtggtggtggtgatggtgacggtgttattgattcttttggattttctatatggacaatcatgttacctgtgaacaaagagagtattacttcattcccaatctgtttcatttccttttcttgttttattggcttagctagaactttcagtatgatgttgaaaagcagtggtgagagaggaaggacatccttgcctttctcctgatcttactggaaaagccttgagtttgtcaacatgatgtatgatgttaaccgcagggtttttaaaaaatgttttctaaaatcaggttgaggtagttcccttcaattactagtttgctgagagtattactctatcatgaatgagtgttagattttgttaaatgctttttctgtatctattggtatgttcatgccatatttcttctttagcttatcattgtgataaattacgttaactgatttttgaatgttgaacgaaccttgcatacctgggttaaacctcaattagttgtggtgtttaattctttttatacaccattgaattagatttgctaatattttgttaataatttttgcgtctatgttcatgagaaatattggtctgtaacttttttgtagtgtctttatctggccttggtattacattaatgctgggatcatagaataaaacactgctcaaagaaatcagcaatgacacaaacaaatggaaaaacattccatgctcatgaatagaaagaatcaaaaacaaacagaatatacattcctctcatctgcacatggcacatgctctaaaactgaccacacagtgagacataaaacaatcctcagcaaaaattttaaaaacaaatttttattttattttattttatttatttatttatttgagatggtgtctcactgtgttgcctgggctggagtgcagtggcatgatcttggctcactgtaacctctgcctccctggttcaagcaattctcctacttcagcctcccaagtagctgggattacatgtgtgcaccaccacgcccagctaatttttgtatttttagtagagacagggtttcaccatgttggccgggctggtcttgaactccttacctcaggtgatccacccagctcagcctcctacagtgctgggattacaggcatgagccactgcacccagccccaaaattttaaaaagcaaaatcgtaccacactcttggaccacagagcaataaaaatagaaaccgatactaagaaaatcactcaaaatcacacaagtacatggaaattaaacaacctgcttctaaatgactgtggggtaaataatgaaattaaggcagaaatgaagtttttctttgaaactaaagagaacacagacacaacataccagatctccggacacagccaaagcagtgttaaggaggaaggaagtttatagcactatacaccaacatcacaaaattagaaagtctcaaattaacaatataatatcgcaactagaggaactagagaaacaagagcaaaccaatcccaaaactagcagaagacaagaaataactaaaatcaaagctgagctgaaggaaactgagacatcaaaaaccatgtggaagaacaaagaatccaggaatttattctttgaaaaaagttaatatagactgctagccagactaataaaaaagcagaagatccaaataaacacaatcagaaatgacaaaggggacactaccacggacccgaaagaaatacaaaaacccctcagagactactgtgaacagctgtatgcacacaagctagaaaacctaaaagaaatggataaattcctgcaaacatacagtcttccaagactgaaccacaaagaaattgaatcctcaaacagaccaataatgagttctaaaactgaaccagtaataaaaagcctaccaaccagtggttcaggcctccaatcctagcactttgggaggctgaaggtgggcagatttcctgagctcaggagtttgagaccagcctgggcaacatggttaaaccccgtctctactaaaatacaaaaaattagccaggtgtggtggagtgcaccagtagtcctagctacttgggaggctgaggcacaagaattgcttgaacctgggaggtgacaaagtgagactctgtctccaaaaaaagaagagctggtgccattcctaatgagactactccaaaaaattgaagaggagggactcctccccaattcattctatgtggacagcatcatgctgataccaaaacctggcagagatacaacaaaaaaagaaaagttcaggccaatatcctctatgaacatagataaaaaattctcaacaaaatactagcaaactgaatccaggagcacatacaaaagacaattcaccacaatcaagtaggctttatctctaggatgcaaggttggttcaacatatgcaaatcaataaatgtaattcatcacataaacagaactaaaaacaaaaaaatgcctatttcaatagatacagaaaagacttttgataaaatttaacattgcttaatgttaaaaaccctcaacaaagtgggcactgaataaacatacttcaaaataataagagctatctataataaacctacagctaacatgatactggataggcaaaagctggaaacattccccttaaaaactggcacaagacaaagatgccctctctcatcactcctactcatgtagtactggaagtcctggccagagcaatcaggcaagagaaagaaataaaaggcattcaaatgtaaagagaggaagtcaaactgttgctatttgcagacaatatgattctatatcagaaaaccccatagtctctgcccaaaggctccttgatctgatgaacaacttcagcaaagtttcaggacataaaatcaatgtacaaaaatgaatagcattcctatacaacaacaatattcaagctgagagctaaatcatgaacacaatcccattcacaatagccacaaaaagaataaaatacctgggaatacaggtaatcaggaagatgaaagatctctacaataaaaattataaaactctgctcaaagaaattagagatgacacaaacaaatggaaaaatattccatgcttggggactggaagaatcaatatcattaaaatggccatactacccaaagcaatttacacattcaatgctatttctataaaactaccaatgacattcttcatagaattaggaaaaactatttaaaatttcatatggaacaaaaaaagagcctgaagagcaaaggtaatcttaagcaaaaggaacaaagctggaggcatcacattacccaacttcaaactatactacaagcttacagtaaccaaaatagcatggtactgatacaaaacagacatatagaccaatgggacagaatagagagaccagaaataatgacacacacctacaaccatctgaccttgacaaaatcaacaaaaacaagcaatggggaaaggactccctatttaataaatggcgctgggctaactggctagccatttgcagaaaattgaaactggaccccttcctcacatcatatacaaaaattaactcaagatggattaaagacttaaacataaaaccaaaactgtaaaaaccctgaaagataacctaggaaataccattctggacagaacatttggcaaagatttcatgagtaagatgccaaaaccaattgcaacaaaaacaaaaactgacaaatgagatacagttaaacaagagcttccaaacagctaaagaaactatcaacagagcaaacagacaacatacagaatgggagaaaatatttcaaattatgcatccaacaaaggtctaatctccagaatctataaggaatttaaacaagttaacaagcaaaaacaaccccattaaaaagtgggtaaaggacatgaacagaagacgaaagaagacatacatgcagccaacaaccatatgaaaaaatgccaaatacttaaagccaactgatcttcgacaaagcatgcaagcacataaattggggaaaggacatcctattcaataatggtgctgggaagactggcaagccacatttagaagaatgaaactgaatcctcatctttcaccttatacaaaaatcaactcaagatgcatcatagacttaaatctaagacctgaaaccataaaaattctagaagataatatcagaaaaactcttctagacattggcttaggcaaataattcatgattaagatgtcaaaagcaaattcaacaaaaccaaaaataaataaaatgagttctaattaaactaaaaggcttctgcacagcaaataataataataataatcagcagagtaaacagacagctcacagagtgtgagaaaatattcacaaattatgcatctgacaaaggactaatatccaggatctacaaagaactcaaatgaatcagcaagaaaaaaaaaccacaaataatcccatcaaaaagtggcaaaggacataaatagacaatatcaaaagaagatatatgaacagccaacgaacatatgaaaaaatgctcaatatcagtaattatcagggaaataaaaattaaaatcacagtgagataccaccgtactcctgcaggactggccataattaaaaagtcaaaaaataatagatgttggcgtggatgtggtataaagggaagacttttacactgctggtgggaatgtaaactagtacaaccactatggaaaacagtacggagattccttaaagaactaaaaagagaactaccattcgatccagcaatcccactactgggtatctacccaaatgaaaagaagtcattatataaaaaagacacacgcacacacatgtttatagcagcacaatttgctattgcaaaaacatggaaccaacctaagtgcccatcaaccaatgagtggataaagcaaatgtggtatatatacagcatggactactactcagccagaaaaaggaataaaataacctcttttgcagcaacttggacggatttggaggccattcccttttttttatttggttctttttttttctgagatggaatctcactttgttgcccaggctggagtgcagtggcacaatcttggctcactgtaacctccgcctcccagattcaagcgattcttctgcctcagcctcctgagtagctgggattacaggcacgtgctaccacgcctggctaatttctgtatttttagtacagatgtggtttcatcatgttggccaggcttgtctcaaacttctgacctcaggtgatctgcctgctttggcatcccaaagtgctgggattacaggtgtgagccaccacgcctggtggagggcattattccaagtgaagtaactcaggaagggaaactcaaatatcatttgttttcacttacaagtgggagctaagctacaatgatgcagaggcataagaatgatataatggaccttgaggactcgagggggaagcctgagagggggatgagggatcaaagactacatattgggtactgtgtacactgctcaggtgatgggtgcatcaaaatctcagaaatcaccactaaagaacttctcatgtaaccaaaaaccacctgtatcccaaaaactattgaaattgaaaaaaaaatattcaaaatcactaattattagggaaatgcaaatcaaaaccacagtgagataccatttcatatcagtcagaatggctattatgaaaaagtcaaaaaaataaaagacgctgacaaggttgtggaggaaagggaatgcttgtatactgctggtgggaatgtaaattagttcagccattgtggaaagcagtttggcaatctgtcaaagaactcaaagcagaattaccattcaacccagcaatcccatgattgggtatatatacccaggagaatatcaattgttctaccctaaagacacacacacacacatgttcatcacagcaatattcacaatagcaaagacatggaatcaacctaaatgcctatcagcagttgactggataaagaaaatgtggtatatatatatacaccatggaacactatgcagccacaaaaaagaatgacatcatgtcctttgcagcaacatggaggccattatcctaagcgaactaacaaaggaacagaaaaccaaatactgcatgttctgacttacaagtgggagctaaacattgagcatataaggacacaaagaagggaacaacagacactggggcctactttagggtggtgggagagaggagccagaggttcatttttctacctattgggtactacgcatattacctgggggatgaaataatctgtacatcaaacctccatgacacgcaaattatctatacaaaaaatctgcacatgtaccccgaacctaaaataaaagtttgaagaaaaaaagaaattgttttttctacttctaacttctaagagagattgcagagaaattgtaagatttcttccttacacagtggaattcaacagtgaattcatttgggctggtgctttctgttttgaaagcttattaattattcattaaatttctttgatataagcctgctcagattgtctatttcttcttgggtaggttttaacagatggtgtcttccaaagatttgtcgatttcatgtaggatattaaattcatgggcatgtagtagtccatagtattcctttattgtcattttaatgtccatgggatctgtccttttcccttctttcatttccataatttgtggtctctctcttatcttcttagaagttgcacataattcttgcctttgctcttcaaggggggttaagtgtttattacctctggcttctttcaagatcttttctttaactttgatttctgaagtttgaatataatatgcctagatgtcaggtttctttggccatttatcccgttcagtgctctctaagcttccttggcctgtgatttggcgtctgacattaatttgggggaaactctcactgattattgcttcacctattacatctgtccctttctctgcttctccttcttgtactcacattatacagagttaacatcttttgtagttgggccacagttcttggatattctgttttgtttcttttcccaatctttcttttctttacttctcagttttggaagtttctattgttacttcctcaagttcagggattctttcatcaagctggtaatgagcctatcaaaggcattcttcatttctgatacaatgttttgatctctagcatttcttttttattccttctaatatatatgcttaaattatctatctgtttttgcattttaaaacagtttgaattagtgacagttttccactaaagcccttggcatactaatcagagttttaaaaaaattcctgatcagataactccaacatttttaccataacgtacttctcattctgatgcttgtttggtctcttcaatctggttttttaaaaaatcttttatgattattattattatctttagagacagggtctcactatgttgcctagtctggccttgaactcctggactcaagtgatcctcccacctcagcctcttaagtagctgggaatacaggcacgcaccattgccccttgctttaccttttagtatgccttgtacttttttattgaaaggtagacctgctgtattgagtaaaaggaactgcagtaaataggctgttagtaatgtagtggcaaggggaagcattctacagtcttataatcaggtctcagtctttgggtgagcctctgcccctggactgtgaatttcagcagtgtttctcaattttgttttttccaccttaggtgggacaggatggctaaagggaattggcattgggtattttccttcccctacatggaaagctagagttggctacaactctatggatatttgtattcccccaggttggttactctgataatatgccagcagactggctctgataaaatagcttctcttcagggaaggccttgctaaaaagagcagaatgcactggcatattttaaaatggtttcttgtctccttccccagcggaaacacgagaggctttttctctgatattcactgttaggacctggtagagttcctggaggcagaacaaaattgtgagaacctttcctcacaaccccactgcaccctctcccccggaagattggaagtcccctagagtttgtaattttcacagttgtccacattgggcctctggtaatgcttcactttcagtgtatgttttcctacactggtactcgttgccacagaggtgtatgctcacaggtttctgttcacacaagctgtgattttctgtatccacctgtcagtcactctaatttggggaggctgcagttagtcctgtgacctcacttctctgatgggtctcagattgctgctgatttttcagtttattcagacttttacttattattaggacagagtggtgaacttctaagctccttacatgctggaccagaaacagaaagtcccttgactagttttatatcagagttttgccagccacatagtattttttcatttaattttttaaaagaatattcaaatttatttaaataggcagataaaattctatgtatttattatttacaatataatgttctgaagtatacacacattgtgagatgataaaatctagctaattaacatatgcattacctcatacttaacatttttgcagtaagaacacttaccatccactctcttagcatttttcaagaatacaatatatcgtcattaactatagtcatcatgctgtacaatagatcttttgaacttattctgcctatctaactgtacttttgtatcctttgacaaacatctccgcaacttccccaccagccacctcaacgtctggcaaccaccattctactcgctgtttctgcaagaccaacttttttagattccatatatgagtgagaccatgtggtgtttgtgtttctgtgcctggcttatttcacttaacataatgtcctccaggtttatccatgtggttggaaatgacaggatttccttctttttacagccgaataatatttatatatatatatgatatatctgatatctgatatatataagatattcatatatacatatgacatatatatcacattttctttatccattcatctgttaatggacatgggttgattccatatcttgactattgtgaacaggggtaaaataaacatgggagtgcttagatgtctccccaacatactaactttatttcctttggatatatacccaacagtgggattattaaatcatatggtagtcttatttttaattttctgaggaaactatatactgtcttccataatggctgtactaatttgcattcccttagtgtgcaaggattcccttttctctacattagtgttctcatcaacacttatcttttgtcgttttgataatagccattctaacaggagtgaagtgatatatcactgtggtttttttttatttgcatttccatgatgattaatgatgcattttttcatatgcctattggtcatttgcatgtcttttgcctatttttaaattgggttgtttttttgctattgagttgtttgaattccctatatatttaggatattaacccttgtattagaagtataatttgcaaatattttccactattctgtagactgtctcttactctgtttcctttgctgtctttctagtttgatgtaatctcatttgtctatttttgcttttgtatcctgtgttgtcgaggtcatatccaaaaagagcatttcccaggccaatattgtggggattttcccctatttttttttttttagtagttctatggttttgggttttacattaatccattttgagttgatctttgtatatggtgtgaggtaagggtctaatttcattcttctgtatttggatatccagttttcaccactgtgtgttcttggcacctttgtcaaaaatcaactaggtgtaaatgtcatttagtttatatggcctaggaattatctaatatttaagaatgtggtacaatttgcacgtaagactatctgaacctggtgccttttttcagagtggtaggccttttactatctttttttattttattccttttattagcctatttcagatttttttttacctcctttagttaattttgataatttgcagttacctagaaaattatcgatttaatcaagattttcaagtctattgatatacacttacagacagattcttctcttttttttgagacagagtctcactctgtcacgaggctggagtgcagtggcgtgatctcagctcactgcaacctccacctcccatgttcaagtgattctcctgcctcagcctcccaagtagctggaactacaggcacacaccaccgtgcccagctaatttttttgtatttttaatagaggcagggtttcaccatgttggccaggatggtctcgatctcttgactccgtgatctgcccacctcggcatcccaaaatgctgagattacaggcgtgaaccaccacacccagcctaaagacagattcttaaataatttttcctatctaccattttgttgcctttctcattccaaatatttatttgccattctctctgtattaatctattagtggaatagcaatagtttttgtctatttcataagtcttttcaatttatgacctataggttttattgttaaaatcttttttgtggttgttgtagtttaaaagtatttctgtttttgtctctattatgcctctcttcaatttcgtttatttatcttttctagttttatgagttgagtgctttaaggaagacaatttcatataagactgtttattccagtaaggttaattcctaccccctgccaacaataaaagtccaatatcattattctgccaccaggtggctggccagtgatactgatttatggtgacatagcagggctcagtgttaatctctgatgttggcaaagtagacacacagcagtgaaagaagccatatcccacatatataattttcatccttcccaccacactttcaataagctcactgagcaatcactggagtggccaaggaaagtggctgctgacttacatccctgaactggccatctggtccatcctttgccatctgattgagaaagtccttagttttgagggccattggtgagcattcataaggcaccaatactgacacactctggacctaaggtggggaaatgggagtggttcaacaggtgcaggtgataagaagtgcattgttggcagataatttaaataataataataataatggcaactacgatttaatcttcttcttcttagcaccatctgctagcaattccaaacaatgccagttcacaatactccctctcaaaaaactttctgctggtctaagttctaaaaagttgcttgtacctggggcaagccactcctaccacccacccttggtataatagaggtttccatccacttaccctgcccctagatcctctcattatcaatcctcagtattgttcttctctagtccctgatgacccagacaagtattagccactgattataagtcattttagactcgtaatgcaggacaactttctttccaggatatgtgaagaaaagatattccacatataattctgcctattacagagaggatttctcttcatcattgtccttgtcatcacacacaattgaggttaatgagaacagtctgcatatagcacagtatcacctaaaaatcaagtttaatgttttgcttctttaatcaactggtcatagggtactcctcccacccatgaagctatgtaagcaggtagaaggtgatgtggctatgcatcaacagtaggaacactgagaatgtgagccgcttgctcacacaactcactggtacatttaaggcctgcttaaactcagtcttatgtcacttgcttagccttgttgagtaagtgctgctaggcaacccaattttatgacttgataagtaagataatacccattcatgataggcagtcttgcagcaaactagatagaacccacatctaggataggagctgattggagttactattactacctaactaattttacaataatcgactgatattctccaaaattacttgttattactaggtaacttgtcatgaagataggaggattcaccactcctttgtctttcaactttgtgatgatgttaataatttctgcaatacctccaggtataaagtattgcttctgatgtattgttcatctgtgttcttgaagttatttgcataaaattgttcatactacccctttactatccttttaatgcctctaggatcagtagtgatgacctctctttcattcctgacaactgtgacttgtacattctcttttttctctgtcttactatattttaatcaattttattaacattttcaaagaacaaacttttgactttgttacttttctctattttctgtcccttttctatgtaaattgcttttcattcttgtatgtatcattttcatatttcttcttaattttggttcaatttcctcctttttctgtcatcttcaagtagaagtgtagatcatttattttaagcattttttctaaaataaacacttaaaagtataaatgtccttctatgcactgctttagctgtttcctacaaatatgaaataccttcattatcatgtagttcaaaatacctttttctcaagttgagaattcttttatttatttatttacttattttttaaattatactttaagttctagggtacatgtgcacaacgtgcaggtttgttacatatgtatacatgtgccatgttggtgtgctgcacccattaactcgtcatttacgttaggtatatctcctaatgctatccttcgccccttcccccaccccacgacaggcccccagtgtgtgatgttccccatcctgtgtccaagtgttctcattgttcaattcccacctatgagtgagaacaagcagtgtttggttttctgtccttgcgatagtttgctcagaatgatggtttccagcttcatccatgtccctgtaaaggacatgaactcatccttttttatggctgcatagtattccatggtgtatatgtgccacattttcttaatccagtctatcattgttggacatttgggttggttccaagtctttgctattgtgaatagtgccacaataaacatatgtgtgcatctgtctttatagcagcatgatttataatcctttgggtatatacccagtaatgggatggttgggtcaaatggtatttctagttctagatccttgaggaatcaccacactgtcttccacaatggttgaactagtttacagtcccaccaacagtgtaaaagtgttcctatttctccacatcctctccagcacctgttgtctcctgactttttaatgattgccattctaactgatgtgagaagttacctcattgtggttttgatttgcatttctctgatggccagtgatgatgagcattttttcatgtgtctgttggctgcataaatgtcttcttttgagaagtgtctgctcatatccttcacccactttttgatggggatgtttgattttttcttgtcaatttatttaagttctttgtagattctggatattagccctttgtcagatgggtagattgtaaaagttttctcccattctgtaggttgcctcttcactctgatgatagtttcttttgctgtgcagaagctctttagtttaattagatcccatttgtcaattttggcttttgttgccattgcttttggtgttttagacatgaagtccttgcccatgcctatgtcctgaatggtatggcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagagaatcctttccccatttcttgttcttgtttttgtcagatttgtcaaagatcagatggttgtagatgtgtggtattatttctgagggctctgttctgttccattggtctatatctgttttggtaccagtaccatgctgttttgattacagtagccttgtagtgtagtttgaagtcaggcagcgtgatgcctccagctttgttcttttggcttaggattgtcttggcaatgcgggctccttttggttccatatgaattttaaagtagttttttccaattctgtgaagaaagtctttggtagcttgatggggatggcattgaatctataaattaccttgggcagtatggccattttcacgatattgattcttcctctccattagcatggaatgtttttccatttgtttgtgtcctcttttattttgttgagcagtggtttgtagttctccttgaagaggtccttcacatcccttgtaaattggattcctaggtattttattctctttgaagcaattgtgaatgggagttcactcatgatttggctctctgtttgtctgttattggtgtataggaatgcttgtggtttttgcacattgattttgtatcctgagactttgctgaagttgcttatcagcttaaggagtttttgggctgagacaatgaggttttctaaacatacaatcatgtcgtctgcaaacagggccaatttgacttcctcttttcctatttgaataccctttatttctttcccctgcctgattgccctggccagaaattccaacactatgttgaataggagtggtgagagagggcatccctgtcttgtgccagttttcaaagggaatgcttccagtttttgcccattcagtatgataatggctgtgggtttgtcctaaataggtcttatcattttgagatatgttccatcaatacgtagtttattcagtttttagcatgaagggctgctgaattttgtcaaaggccttttctacatctattgagataatcatgtggttgtctttggttctgtttatatgatggattgcctttattgatttgcatatgttaaaccaccgttgcatcccaaggatgaagccaacctgatcatggtcgataagcttttgatgtgctgctggatttggtttgccagtattttattgaggatttttgcatcgatgttcatcagggatattggtctaaaattctctttttttgttgtgtctctgccaggctttggtatcaggatgacgctggcctcataaaatgagttagggaggattccctctttttctattgattggaatagtttcagaaggaatggtatcagctcctctttgtacctctggtagaattcggctgtgaatccatctggtcctggacattttttggttggtaggctattcattattgcctcaatttcagagcctgttattggtctgttcagggattcaacttcttcctggtttagtcttgggagggtatatgtatccaggaatttatccatttcttctagattttctaatctatttgcatagagatgtttatagtattctctgacggtagtgtgtatttctgtgggattggtggtgatatcccctttatcattttttattgcatctatttgattcttctctcttttgttctttattagtcttgctagtggtctgtcaattttgttgatcttttcaaaaaaccagctcctggattcattgattttttgaagggttttttgtgtctgtatctccttcagttctgctctgatcatagttatttcctgccttctgctaccttttgaatgtgtttgctcttgcttttctagttcttttaattgtgatgttagggtgtcaatattagatctttcctgctttctcttgtgggcatttagtgctataaattttcctctacacactgctttaaatgtgccccagagagtctggtatgttgtgtctttgttctcattagtttcaaagaacatctttatgtctaccttcatttcgttatgtacccagtagtcattcaggagcaggtggctcagttttcatgtagttgagcagttttgagtgaatttattaatcctgagttctagtttgattgcactgtggtctgagagacagtttgttataatttctgttcttttacatttgctgaggagtgttttccttccgtcaattttggaataagtgtgatgtggtgctgagaagaatgtatattctgttgatttggggtggagagttctgtagatgtctgttaggtctgcttggtgcagagccaagttcaattcctggatatccttgttaactttctgtctctttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaataggactgcaacccctgcttttttttgttttccatttgcttggtggatcttcctccatccctttattttgagcctatgtgtgtctctgcatgtgagatgggtctcctgaatacagcacactgatgggtcttgactctttatccaatttgccagtctgtgtcttttaattggagcatttacccatttacatttaaggttaatattgttatgtgtgaatctgatcctgtcattatgatgttagctggttattttgctcgttagttgatgcagtttcttcctagcctcaatgatctttacaatttggcatgtttttgcagtggctggtaccagttgttcctttccatgtttagtgcttccttcaggagctcttgtaaggcaggcctggtggtgacaaaatctctcagcatttgcttgtttgtaaaggattttatttctccttcacttatgaagcttagtttggctggatatgaaattctgggttgaaaattcttttctttaagaacgttgaatactggcccccactctcttctggcttgtagagtttctaccgagagatctgctgttagtctgatgcgcttccctttgtgagtaacccgacctttctctctggctgcccttaacattttttccctcatttcaactttggtgaacctgacaattatgtgtcttggagttgctcttcttgaggagtatctttgtgacgttctctgtatttcctgaatttgaatgttggcctgcgttgctaggttggggaagttctcctggatagttctcctgtagagtgttttccaacttggttccattctccccatcactttcaggtacaccaatcagatgtagatttggccttttcacatagttccatatttcttggaggctttgttcatttctttttactcttttttctttaaacttctcttgtcacttcatttcattcatttgatcttcaatcactgataccctttcttccactttatcgaattggctactgaagcttgtgtatgtgtcacgtagttctcg

SEQ ID NO: 12763 - DNA, 6152 bp, Homo sapiens
ttttggtgattttttttaattattattatactttaagttttagggtacatgtgcacaatgtgcaggtttgttacatatgtatacatgtgccatgttggtgtgctgcacccattaactcatcatttagcattaggtatatctcctaatgctatccctcccccctccccccaccccacaacagtccccacagtgtgatgttccccttcctgtgtccatgtgttctcattgttcaattcccacctatgagtgagaacatgtggtgtttggtttttttgtccttgcgatagtttgctgagaatgatggtttccagtttcatccatgtccctacaaaggacatgaactcatccttttttatggctgcatagtattccatggtgtatatgtgccacattttcttaatccagtctatcgttgttggacatttgggttggttccaagtctttgctattgtgaatagtgccacaataaacatacgtgtgtatgtgtctttatagcagcatgatttataatcctttgggtatatacccagtaatgggatggctgggtcaaatggtatttctagttctagatccctgaggaatcaccacactgacttccacaatggttgaacaagtttacagtcccaccaacagtgtaaaagtgttcctatttctctacatcctctccagcacctgttgtttcctgactttttaatgatcgccattctaactggtgtgagatggtatctcactgtggttttgatttgcatttctctgatggccagtgatgacgagcattttttcatgtgtttgttgactgcataaatgtcttcttttgagaagtgtctgttcatatccttcacccactttttgatggagttgttttttttcttgtaaatttgtttgagttgattgtagattctgcatattagccctttatcagatgagtaggttgcaaaaattttgtcccattttataggttacctgttcactctgatggtagtttcttttgccgtgcagaagctctttagtttaattagatcccatttgtcaattctggcttttgttgccattgcttttggtgttttagacatgaagtccttgcccaagcctatgtcctgaatggtattgcctaggttttcttctagggtttttatggttttaggtctaacatgcaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatggttgcagatatgcggcattatttctgagggctctgttctgttccattgatctatatctctgttttggtgccagtaccatgctgttttggttactgtagccttgtagtatagtttgaagtcaggtagcatgatgcctccagctttgttcttttggcttagggttgacttggcaatgcagcctcttttttggttccatatgaactttaaagtagttttttccaattctgtgaagaaagtcattggtagcttgatggggatggccttgaatctataaattaccatgggcagtatggccattttcacgatattgattcttcctacccatgagcatggaatgttcttccatttgtttgtatcctcttttatttcattgagcagtggtttgtagttctccttgaagaggtgcttcacatcccttgtaagttggattcctaggtattttattctctttgaagcaactgtgaatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgccatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaataccaaatttattgagagtttttagcatgaaggttgttgaattttgtcaaaggccttttctgcatctattgagataatcatgtggtttttgtctttggttctgtttatatgctggattacatttattgatttgtgtatgttgaaccagccttgcatcccagggatgaagcccacttgatcatggtggataagctttttgacgtgctgctggattcggtttgccagtattttattgaggatttttgcatcaatgttcatcaaggatattggtctaaaattctcttttttggttgtgtctctgccaggctttggtatcaagatgatgctggcctcataaaatgagttagggaggattccctctttttctattgattggaatagtttcagaaggaatggtaccagctcttccttgtacctctggtagaatttggctgtgaatccatctggtcctggactttttttggttggtaagctattgattattgccacaatttcagagtctgttattggtctattcagagattcaacttcttcctggtttagtcttgggagggtgtatgtgttgaggaatttatccatttcttccagattttctagtttatttgtgtagaggtgtttatagtattctctgatggtagtttgtatttctgtgggatcggtggtgatatcccctttatcattttttattgcgtctatttgattcttctcccttttcttctttattagtcttgctagcagtctatcgattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgacgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggtttttcaatttccatgtagttgagcagttttgagtgagtttcttagtcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagttgtctattaggtctgcttggtgcagagctgagttcaattcctggatatccttgttaactttctgtcttgttgatctgtctaatgttgacagtggggtgttaaagtctcccattattattgtgtgggggtctaagtctctttgtaggtcactaaggacttgctttatgaatctgggtgctcctgtattgggtgcgtatatatttaggatagttagctcttcttgttgaattgatccctttaccatgatgtcatggccttctttgtctcttttgatctttgttggtttaaagtctgttttatcagagactaggattgcaacccctgcctttttttgttttccatttgcttggtagatcttcctctacgaaggagcctatgtgtgtctttgcatgtgagatgggtttcctgaatacagcacactgatgggtcttgactctttatccaatttgccagtctgtgtcttttaattggagcatttagcccacttatgtttaaagttaatattgttatgtgtgtatttggtcctgtcattatgatgttagctggttattttgctcgttagttgatgcagtttcttcctagccttgacggtctttacattttggcatgtttttgcagtggctggtaccagttgttcctttccatgtttagtgcttccttcaggagctcttttagggcaggcctggtgttgacaaaatctctcagcatttgcttgtctgtaaagtattttatttctccttcacttatgaagcttagtttgactggatatgaaattctgggttgaaaattcttttctttaagaatgctgaatattggcccccactctcttctggcttgtagagtttctgctgagagatccactgttggtctgatgggcttcccgttgtgggtaacccgacctttctctctggctgtccttaacattttttccttcatttcaactttggtgaatctgacaattatgtgtcttggagttgctcttctcgaggagtatctttgtggcgttctctgtatttcctgaatttgaatgttggcctgccttgctacattggggaagttctcctggataatatcctgcagagtgttttccagcttggttccattctccatgtcactttcaggtacaccaatcagacatagatttggtcttttcacatagtcccatatttcttggaggctttgttcatttctttttattcttttttctctaaacttcccttctcgcttcacttcattcatttcatcttccatcactgataccctttcttccagttgatcgcatcagctcctgaggcttctgcattcttcacgtagttcttgagccttggctttcagctccaccagctcctttaaggacttctctgcattggttattctagttatccattcctctaatttttttcacagttttaaacttctttgccattggtttgaatttcctcctgtagctccgaatagtttgatcttctgaagccttcttatctcagctcatcaaagtcattctccgtccagctttgttccgttgttggtgaggagctgcattcctttggaggaggagaggcactctgctttttagagtttccagtttttctgctctgttttttccccatctttgtggttttatctacttttggtctttgacgatggtgacatacagaagggtttttggtgtggatgtcctttctgtttgttagttttccttctaacagataggaccctcagctgcaggtctgttggagtttgctagaggtccactccagaccctgtttgcctgggtatcagcagcggtggctgtagaacagcggatcttggtgaaccgcaaatgctgctgcgtgatcgttcatctggaagttttgtctcagaggagtacccggccgtgtgaggtgtcagtctgtccctactggggggtgcctcccagttaggctgctctggggtcaaggacccacttgaggaggcagtctgcccgttctcagatctccagctgcgtgctgggagaaccactactctcttcaaagctgtcagacagggacatttaagtctgcagaggttactgctatctttttgtttgtctgtgccctgcccccagaggtggagcctacagaggcaggcaggcctccttgagctgtggtgggctccacccagttcgagcttcccggctgctttgtttacctaatcaagcctgggcaatggcagatgcccctcccccagcctcactgccaccttgcaatttgatctcagactgctgtgctagcaatcagcgagactccgtgggcgtaggcccctccaagccaggtgcgggatataatctcctggtgtgccgttttttaagcctgttggaaaagcacagtattagggtgggagtgacccgattttccaggtgccatctgtcacccctttctttgactaggaaagggaactccctgaccccttgtgctcttgagtgagggaatgcctcgccctgctttggctcgtgcatggtgcgctgcacccactgtcctgcaaccactctctggcactccctagtgagatgaacccggtacctcagatggaaatgcagaaatcacccgtcttctgtgtcgctcacactgggagctgtagactggagctgttcctattcggccatcttggctccatcc

SEQ ID NO: 12764 - DNA, 5159 bp, Homo sapiens
attctctttttttattattatactttaagttttagggtacatgtgcacaatgtgcaggtttgttacatatgtatacatgtgccatgttggtatgctgcacccattaactcgtcacttagcattaggtatatctcctaatgctatccctcccctatccacgcaccccacaacaggctccggtgtgtgatattccccatcctgtgtccatgtgttctcattgttcaattcccacctatgagtgagaacatgcagtgtttggttttttgtccttgcaatagtttgctgagaatgatggtttccagcttcatccatgtccctacaaaggacatgaactcatccttttttatggctgcatagtactccatgatgtatatgtgccacattttcttaatccagtctatcattgttggacatttgggttggttccaagtctttgctattgtgaatagtgccgcaataaacatatgtgtgcatgtgtctttataggagcatgatttataatcctttgggtatatacccagtaatgggattgctgggtcaaatggtatttctagttctagatccctgaggaatcatcacactgacttccacaatggttgaactagtttacagtcccaccaacagtgtaaaagtgttcatatttctccacatcctctccagcacctgttgtttcctgacattttaatgatcgccattctaactggtgtgagatggtatctcactatggttttgatttgcatttctctgatggccagtgatgatgagcattttttcatgtgttttttggctgcataaatgtcttcttttgggaagtgtctgttcatatccttcatccacttgttgatggggttttttgtttttttcttgtaaatttgtttgagttcattgtagattctggatattagccctttgtcagaggagtagattgcaaaaattttctcccattctgtaggttgcctgttcactctgatggtagtttcttttgctgtgcacaagctctttactttaattagatcccaattgtcaatttttgcttttgttgccatggcttttggtgttttagacatgaagtccttgcccatgcctatgtcctgaatggtattgcctaggttttcttctagggtttttatggttttaggtctaacatttaaatctttaatccatcttgaattaattttagtataaagtgtaaggaagggatccagtttcagctttctacctatggttagccagttttcccagtagcatttattaaatagggaatcctttccccattgcttgtttttgtcagggttgtcaaagatcagatagttgtagatacgtggcattatttctgagggctctgttctgttccattggtctatatctctgttttggtaccagtaccatgctgttttggttactgtagccttgtagtatagtttgaagtcaggtagtgggatgcctccagctttgttcttttggcttaggattgacttggcaatgtgggctcttttgtggttccatatgaactttaaagtagttttttccaattctgtgacgaaagtctttggtagcttgatggggatggcattgaatctataaattaccttgggcagtatggccattttcacgatattgattcttcctacccatgagcatggaatgttcttccatttgtttgtatcctctcttatttcattgagcagtggtttgtagttctcattgaagaggtccttcacatcccttctaagttggattcctaggtattttattctctttgaagcaattgtgaatgggagatcattcatgatttggctctctgtctgttattagtgtataagaatgcttgtgatttttgtacattgattttgtattctgagactttgctgaagttgcttatcagcttaaggagattttgggctgagacaatggggttttctgatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtattatattggctgtgggtttgtcataaatagctcttattattttgagatatgtcccatcaatacttaatttattgagagtttttagcatgaagggctgttgaattttgtcaaaggccttttctgcatctattgagataatcatgtggtttttgtcgttggttctgttgagatgctggattacatttattgatttgcgtatattgaaccagccttgcatcccacggatgaagtccacttgatcatggtggataagctttttgatgtgctgctggattcggtttgccagtattttattgaggatttttgcatggatgttcattagggatattggtctaaaattctctttttttgttgtgtctctgcccggctttggtatcaggatgatgctggcctcataaaatgagttaaggaggattccttctttttctattgattggaatagtttcagaaggaatggtaccagctcctccttgtacctctggtagaattcggctgtgaatccatctggtcccagacttttttttggttggtaagctattaattattgcctcaatttcagagcctgttattggtccattcagagattcaacttcttcctggtttagtcttgggagggtgtatgtgtccaggaatttatccatttcttccagattttctagtttatttgtgtagaggtgtttatagtatgctccgatggtagtttgtatttctgtgggatttgtggtgatatcccctttatcattttttattgcatctatttgattcttctctcttttcttctttattagtcttgctagtggtctatcaattttgtttatcttttcgaagaaccagctcctggattcattgattttttgaagggtttttttgtgtctctatttccttcagttctgctctgatcttagttgtttcttgccttctgctagcttttgaatgtgtttgctcttgcttctctagttcttttaattctgttgttagggtgtcaattttatatctttcctgctttctcttgtgggcacttagtgctataaatttccctctacacactgctttgaatgtgtcccagagattctggtatgttgtctctttgttctcgttggtttcaaagaacatatttatttctgccttcatttcattatgtacccagtagtcattcaggagcaggctgttcagtttccatgtagttgagaggttttgagtgagtttcttaatcctgagttctagtttgattgcactgtggtctgagagacagtttgttataatttctgttcttttacatttgctgcggagtactttacttccaactgtgtggtcaattttggaataggtgtggtgtggtgctgaaaagaatgaatattctgttgatttggggtggagagatctgtagatgtctattaggtccgcttggtgcagagctgagttcaattcctggatatccttgttaactttctgtctcattgatctgtctaatgttgacagtggggtgttaaagtctcccattattattgtgtgggagtctaagtctgtttctaggtctctaagcacttagtttatgaatctgggtgctcctgtattgggtgcatatatatgtaagatagttagctcttcttgttgaattgatccctttaccattatgtaatggccttctttgtctcttttgatttttgttggtttaaagtctgttttatcagagactaggattgcaacccctgccttttttgttttccgtttgcttggtagatcttccccccctcctttattttgagcctatgtgtgcctttgcatgtgagatgggtttcttgaatacagcacactgatgggtcttgactcttcatccaatttgccagtctgtgtcttttaattggagcatttagcccatttacatttaaggttaatattcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcatgagccactgcgcccggccaggttaatattcttatgtgtgaatttgatcctgtcatcatgatgttagctggttattttgctcattagttgatgcagtttcttcctagcctagatggcctttacaatgcggcatgtttttgcagtggctggtaccggttgttcctttccatgtttagtgctttcttcaggagctcttgtagggcaggcctggtggtgacaaaatctctcagcatttgcttgtctgtaaaggattttatttctccttcacttatgaagcttagtttggctggatatgaaattctgggttgaaaattcttttaagaatgctgaatattggcccccactctcttctggcttgtagagtttctgccaagagatcagctgttagtctgatgggcttccctttgtgggtaacccgatctttctctctggctgcccttaacattttttccttcatttcaaccttggtgaatctgacaattatgtatcttggagttgctcttctcgaggagtatctttgtggcgttctctgtatttcctgaatttgaatgttggcctgccttgctatattggggaagttctcctggataatatcctgcagagtgttttccaacttggttccattctccctgtcactttcaggtacaccaatcagacacagatttggtcttttcacatagtcccatatttcttggaggctttgttcgtttctttttttttttctctaaacttttcttcttgcttcatttcattcatttgatcttccatcactgatacgctttcttccagttgattgaatcagctactgaggcttgtgcattcatcatgtagttctcgtgctgtggttttcagctc

SEQ ID NO: 12765 - DNA, 36631 bp, Homo sapiens
aagcctcagtagccgatgggatcaagtggaagaaagggtatcagtgatggaagatcaaatgaatgaaacgaagtgagaagtttagacgaaaaagaataaaaagaaattaacaaagcctccaagaaatatgggactatgtgaaaagaccaaatctatgtctgattggtgtacctgaaagtgacagggagaatggaaccaagttggaaaacactctgcaggatattatccaggagaacttccccaatctagcaaggcaggccaacattcaaactcaggaaatacagagaatgccacaaagatactcctcaagaagagcaactccaagacacataattgtcagattcaccaaagttgaaatgaaggaaaaaatgttaagggcagccagagagaaaggtggggttacccacaaagggaagcccatcagactaacagctgatctctcagcagaaactctacaagccagaagagagtgggggccaatattcaacattcttaaagaaaagaattttcaaaccagaatttcatatgtagccaaactaagcttcataagtgaaggagaaataaaatagtttacagacaagcaaatgctgagagattttgtcatcaccaggcctgccctacaagagctcccgaaggaagcactaaacatgaaaaggaacaagtggtaccagccactgcaaaaacatgccaaattgtaaagactgtcgaggctaggaagaaactgcatcaactaatgagcaaaataaccacctaacatcataatgacaggatcaaattcacacataacaatattaactttaaatgtaaatgggctaaatgctccaattaaaagacacatactggcaaattggatagagtcaagacccatcagtgtgctgtattcaggaaacccatagcaagtgcagagacacacataggctcaaaataaagggatggaggaagacctaataagcaaatggaaaacaaaaaaaggcagtggttgcaaacctagtctctgataaaacagactttaaaccaacaaagatcaaaagagacaaagaaagccattacataatggtaaagggatcaattcagcaagaagagctaactatcctaaatatttatccacccaatacaggagcacccagattcataaagcaagtgattagaggcctagaaagagacttagactcccacacaataataatgggagattttaacaccccactgtcaacattagacaggtcaacgagacagaaagttaacaaggatatccaggaactgaactcagctctgcaccaagtggacctaatagacatctacagaactctccaccccaaatcaacagaatagacattcttctcagcaccacaccgcacttattccaaaattgaccacatagttggaagtaaaggtctccttagcaaatgtaaaagaacagaaattataacaaactgtctctcagaccacagtgcaatgaaactaggattcagcataaagaaattcactcaaagccgctcaactacatggaaaccgagcaacctgctcctgaatgactactgggtacataatgaaatgaaggcagaaataaagatgttctttgaaaccaacgagaacaaagacacaacataccagaatctctgggacacattcaaggcagtgtgtagagggaaatttatagcactaaatgcccactagagaaagcaggaaagatctaaaattgacaccataacatcacaattaaaagaactagagaagcaagagcaaacacattcaaaagctagcagaaggcaagaaataactaagatcagagctgaactgaaggaaataagagacacaaaaacccttcaaaaaatcaatgaatccaggagctgcttttttgaaaagatcaacaaaattgacagactgctagcaagactaatacagaagaaaagagagcagaatcaaatagacgcaataaaagatgataaaggggatatcaccactgatcccacagaaatacagactaccatcagagaataatactataaatacctctacgcaaataaactagaaagtctagaagaaatggataaattcctcgacacgtacacccccccaagactaaatcaggaagaatttgaatccctgaatagaccaataacaggctctgaaattgaggcaataattaatagcttaccaatcaaaaaaagtccaggacccaatggattcactgccaaattctaccagaagtacaaggaggagctggtaccattccttctgaaattattccaatcaatagaaaaagagggaatcctacctaactcattttatgaggccagcattatcctgataccaaaacctggcagagacataacaaaaaaagacaattttagaccaatatccctgacgaacatcgatgcagaaattctcaataaaatactggcaaaccgaattcagcagcatatcaaaaaccttatccaccctgataaagtgggcttcatcttgaaaagtcctttgacaaaattcaacaacccttcatgctaaaaactctcaataaattaggtattgatgggatgtatctcaaaataataagagctatttatgacaaacccacaggcaatatcatactgaatgggcaaaacctggaagcattcccttggaaaactggcacaagacagggatgccctctctcaccactcctattcaacatagtgttggaagttctggccagggcaattaggcaggagaaggaaataaagggtattgaattaggaaaagaggaagtcaaattgtccctgtttgcagatgacatgattgtatatctagaaaaccccatcgtctcagccccaaatctccttaagctgataggcaacttcagcaaagtctcaggatacaaagtcaatgtgcaaaaatcacaagcattcttacacaccagtaacagacagagagccaaaccatgagtgaactcccattcacaattgcttcaaaaagaataaaatacctaggaatccaacttacaagggatgtgaaggacctcttcaaggagaactacaaaccactgctcagtgaaataaaagaagatacaaacaaatggaagaacattccatgctcatgggtaggaagaatcaatatcatgaaaatggccatactgcccaaggtaatttgtagattcaatgccatctccatcaagttaccaatgactttcttcacagaattggaaaaaactactttaaagttcatatggaaccaaaaagagcccgcattgccaagtcaatcctaagccaaaagaataaagctggaggcatcacactacctgacttcaaactatactacaaggctacagtaaccaaaacagcatggtactggtaccaaaacagagatatagaacaatggaacagaacagagccctcagaaataacgccacatatctataaccatctgatctttgacaaagctgacaaaaaccagcaatggggaaaggattccctatttaataaatggtgctgggaaaactggttagccatatgtagaaagctgaaactggatcccttccttacaccttatacaaaaatcaattcaagatggattaaagacttacatgttagacctgaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaacttttgcaacctactcatctgacaaagggctaatatccagaatctactatgaactcaaacaaatttacaagaaaaaaacaaacaaccccatcaaaaagtgggcaaaggatatgaacagacacttctcaaaagaagacctttatgcagccaaaggacacatgaaaaaacggtcatcatcactggccatcagagaaatgcaaatcaaaaccacaatgagataccatctcacagcctttagaatggcgatcattaaaaggtcaggaaacaagaggtgtggagaggatgtggagaaataggaacacttttacactgttggtgggactgtaaactagttcagccattgtggaggtcagtgtggcgattcctcagggatctagaactagaaataccatttgacccagccatcccattactggttatatacccaaaggattataaatcatgctgctataaagacacatgcacacatatgtttattgaggcactattcacaatagcaaagacttggaaccaacccaaatgtctaacaatgatagactggattaagaaaatgtggcacatatacaccatggaatactatgcagccataaaaaatgatgagttcatgtcctttgtagggacatggatgaaactggaaaccacctttctcagcaaactattgcaaggacaaaaaacaaaacactgcatgttctcactcaccggtgggaattgaacaatgagaacacatggacacaggaaggggaacatcacacaccggggactgttgtggggtggggggaagggggagggatagcattaggagatatacctaatattaaataacgagtcaatggctgcagcacaacaacatggcacatgtatacatatgtaactaacctgcacattgtgcacatataccctaaaacttaacgtataataataaaaaaaaaagagtctgaacacccaaagcaatcttaagcaaaaagaacaaagctggaagcaccacactatctgacttcaaactatagtacaaggctacagtaaccaaaacagcatggtactagtagaaaaacaaacacatagataaatgaacaggttagagaacccagaaataaatctgcacaccttacaaccatctgatctttgacaatgtcaacagtaagaagcaatggggtgaagacttcctattcaataaatggtgttgtgctaactggctagccatatgcagaatattgaaaatttacatcttcctttcaccacatacaaaagttaattcaagatggattaaagacttaaatgtaaaacctaaaactacagaaatcttggaagaaaacctgtgaaattccattctggacataggccctggcaaggatttcatgatgaagacttcaaaagaaactgcaatgtaaacaaaaattaaatggaacttaattaaactaaagagtttctgcacagcaaacaaaattgtcaacagaataaacagacaacttacagaatggaagaaaatacttgcaaactatgtgtatgacaaagatctaatacccagcatctataaggaacttaaattaacaagcaaaaaaccacaacctccttaaaaaataggcaaagaatatcaacagacacttctcaaaagaagacatatacatagccaacaagcatatttaaaaattctcaacatcactaatcatcagagaaatgcaaatcaaaaccacaatgagataccatctcacaccagtcagaatggctattattaaaatgtcaaaaaagtaacagattctagcaaggttgcagagaaaagagaatacttacactctgctggtgggaatgtaaattagttcagccactgtgaagggcagtttggtgatttctcaaagaacttaaaacagaacttaaaaactacctatgggtactatgctcattacctgtgtgacgaaacattctgtacaccaagcccccacaacatgcaatttacccatgtaacaaaccttcaaatgtagctgccgaacctaaaataagaggtggaaaaaaataatttttaaaaatctatctggtctttaatgggtatgtagtatatttttagtttgagactttttaaataaaatctatttttgtttgttttgtttttaatgtgttttttgtttgtttgcttttgtttagttacctgcttagactaattcaaactggggtgaagtgatatctcattgtggttttgatttgcatttccctactgattagtcatgttgagcatattatatttacctattggtcattcgtatgtcttcttttcagagttgtctaatcaggtcttttgccctttaaaatttaaataacttacttttttgccattgagctctttgagttccttatatattctggatcttaatccctttggatacgtagtttgcagatattttctaccattctgtagcttatttcctttgctgtgcagagcttgttagttagataaaatttcatttgtctattttgttttgtattaccagtgcttttgaggtcttatcgaaaatcttttcccagaccaacatgaagcattcccctatattttcttcttgtagtttcacaattttgggtcttacatttaagtctttaacccatcttcatttgattttgtatatggtgagatatagggctctagttttgttcttctgcatatggatattcagttttcccagcactatttattgaagagactgttctgtccccaatgtgtgtcttggcacttttgttaaaaataggttggctgtaaaggcatggatttatttctgggttatatattctgttccgctgatctatgtatctgtttttataccagtaccatgctgttttggttactatagttttgtagtatattttgaaatcaggtagtgtgatttctacagatttgccctttttgctcaagattactttggcttttggggtctttgatggttcaatattaatttagaatcatcttttctatttctatgaagtatgtcattggtattttgatagagattacattgaatctgtagattgctttgggtagtatgggcattttaacaatgccaattatttcaatctgtgaacataaaatacgatatgatttggccctgtgtccccacccaaatctcatcttgtagccaccataattcccatatgttgtgggagggacctagtgggagataattgaatcatggggacaagtctttcctgtgctgttctcatgttagtgaatgagtctcatgagatatgatagttttaaaaacagtagtttccatgcacaaactctcttctctcttgctgctgctgtgaaagaagtgccttttaccttctgccatgactgtgaggccaccccagctacgtggaactgtgagtccaaataaacctctttcttttgtaaattatctagtctcagatatgtctttattagcaggacgaaaatgaactagtacaaaatacctttccaataatttttgtccttttcaatttctttcatcagtgttttatagatttttttgtagagtttttacctcctttgttacatttattcttaagtatcttatattttgtagctattgtacatggaattgttttcttgatttatttttcagatattttgatgttggtgaaggaaatattactgctttttgtatatgcatttaatatcctgaaattttactgaatttattagtgctcatggctttttgatgaagtaattagtattttctgtatataaagttgtgatctccacaaacagggataatttgacttccttctttttaattgtatgccccgtatttctttctcttgcctaattaccctggctaggagttccagtacaatgttgactagaagtagtgaaagtggacatctttgcttagttccagattttagagaaatttctttcatcttttccccattttgttttatattagctgtgggtttctcatatgtggcttttattgtgtttaggtacgttccttatatacctaatttattgataacttttatcatagtgggatgttgaattctatcaaatgctttctctgtttctattgaaatgattacgtgcttttgtcctttattctattaatgtgatgcagtacatttattaatctgaatactttgaatcatccttgcatccctggaatgaatgccacttgattttaaaggctggtcttttaagtattctgttaaatttagtttgctagcattttcttgaggatttttgcatgcgtttcattagggatattggcctgtagtttttcctattttattttatttttttgagaaagtgtctcactctgtcacccaagctggagtgcagtggcacaatcacatctcaccacagcctcaacctcctgggcttgggtgatcctccaacctcagcctcctgagtagctaggactacaggcgcccaccaccatttttggctaatatttgtactttttttagagacaaggtttcatcatgttgacaggctggtcttgaactcctgggctcaagtgatccaccctccttggcttcccaaagtgctaggattacaggcatgagcaaccacttctgtcctgtaattttcttttttgtttttgttgtgtcatctagtttttatatcgggctaatgaatgctagtctcaaataataagtctggacaaatttactctcattcagtttttttgggggcagtttgagaagaacaggcattagttatttttaaaatatttggtagaattcagcagtgaggtcatcagctcctgtgctttctttaatgggagactttaaactattgtttcaatcttgttactcattattggcctgtttgaattttctgtttcttcatgattcaatcttgtggttgtatgagtccaggcatttacctatttcttctaagttttacaatttgttttcatatagttgttcataatggtctcttatggtcctttgtatttatattatattatttgtaaagtctccttttatatctatgattttatttttttgactcctctttttttcttaatttgtctagttaaaagtttgtcaggttttgtttttgatttttgagacagagtctagctccattgcccaggctggagtgcagtggcacgatctctgctcactgcaacctctgcctcccaggttcaagtgattctcctgattcagcctccctagtggctggaattacaggggcctgccaccacaatcagctaatttttgtatttttagtagagatggggtttcaccatgttgctcaggctggtgttgaactcttaacaagtgatccaccctcctcggcctcccaaagtgctgggattaagtggtgagccaccgtgcctggccaagtgttttatattttgaaaaaacgaagtcttctttgttattcttttgtgttgttttttaaggctctatttaatttatttctgtttttacatttatcgttgcttctcttctactagttttggcttgatgttgttcttgtttttctagttccttgagcaacatgaggttatctgaaatctttctactttttaaatgtaagcctttattgctgtagacttccctcttagaaatgcttttgctgtattccataggttttgttttgttttttttatttttttatttttttattattatactttaagttttagggtaatgtgcacattgtgcatgttagttacgtatgtatacatgtgccatgctggtgcgcggcacccactaactcgtcatctagcattaggtatatctcccaatgctatccctaccccctccccccaccccacaacagtccccagagtgtgatgttccccttcctgtgtccatgtgatctctttgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaagtctttgctattgtgaataatgccgcaataaacacacgtgtgcatgtgtctttatagcagcatgatttataatcctttgggtatatactcagtaatgggatggctgggtcaaatggtatttctagttctagatccctgaggaatcgccacactgacttccacaatggctgaactagtttacagtcccatcaacagtgtaaaagtgttcctatttctccacatcctccccagcacctgttgtttcctgactttttaatgattgccattctaactggtgtgagatggtatctcattgtggttttgatttgcatttctctgatggccagtgatgatgagcattttttaatgtgttttttggctgcataaaggtcttcttttgagaagtgtctgttcatgtcctttgcccactttttgatggggttgtttgtttttttcttgtaaatttgtttgagttcattgtagattctcgatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttgtagggtttttatggttttagctctaacgtttaagtctttaatccatcttgaattaatttttgtatgaggtgtaaggaagggatccagtttcagctttctacatatggctagccaattatcccagcaccatttattaaatggggaatcctttccccattgctggtttttctcaggtttgtcaaagatcagatagttgtagatatgtggcattaattttgagggctctgttctgttccattgatctatatctctgttttggttccagtaccatgctgttttggttactgtagccttgtagtatagtttgaagtcaggtagtgtgatgcctccagctttgttcttttggcttacgattgacttggcaatgcgggctcttttttggttccatatgaactaaaaatagttttttccaattctgtgaagaaaggcattggtagcttgatggggatggcattgaatctgtaaattaccttgggcagtatggccattttcatgatattgattcttcctacccatgagcatggaatgttcttccatttgtttttatcctcttttatttcattgagcagtggtttgtagttctccttgaagaggtccttcacatcccttgtaagttggattcctaggtattttattctctttaaagcaattgtgaatgggatttcactcatgatttggctctctgtttgtctgttgttggtgtataagaatgcttgtgatttttgtacattgattttgtatcctgagattttgctgaagttgcttatctgcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccttgtcttgtgccagttttcaaagtgaatacttccagtttttgcccattcagtatgatattggctgtgggtttgtcatagatagctcttattattttgaaatacgtcccatcaatacctaatttattgagagttttgagcatgaagggttgttgaattttgtcaaaggtcttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttggcagtattttattgaggatttttgcatcaatgttcatcaaggatattgattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaggtattgattattgccacaatttcatatcctgttattggtctattcagagattcaacttcttcctggtttagtcttgggagagtgtatgtgtcgaggaatttatccatttcttcttgattttctagtttatttgcgtagaggtgtttgtagtattctctgatggtagtttgtatttccgtgggatcggtggtgatatcccctttatcatttttttattgtgtctatttgattcttctctctttttttctttattagtcttgctagtggtctatctattttgttgatcctttcaaaaaaccagctcctggattcattaattttttgaagggtttttgtgtctctatttccttcagttctgctctgattttagttatctcttgccttctgctagcttttgaatgtgtttgctcttgcttttctagttcttttaactgtgatgttaggatgtcaattttggatgtttcctgctttctcttgtgggcatttagtgctataaatttccctctacacactgctttgaatgcgtcccagagattctggtatgttgtgtgtttgttcttgttcatttcaaagaacatctttatttctgccttcatttcattatgtacccagtagtcattcagaagcaggttgttcagtttccatgtagttgtgcggttttgagtgagattcttaattctgagttctaatttgattgcactgtggtctgagagatagtttgttataatttctgttcctttacatttgctgaggagagctttactgccaactatgtgatcaattttggaataggtgtggtgtggtgctgaaaaaaatgtatattctgttgatttggggtggagagttctgtagatgtctattaggtccgcttggggcagagctgagttcaattcctgggtatccttgttgactttctgtcttgttgatctgtctaatcttgacagtggggtgttaaagtctcccattattaatgtgtgggagtctaagtctctttgtaggtcactcaggacttgctttatggatctgggtgctcctgtattgggtgcatatatatttaggatagttaactcttcttgttgaattgatccctttaccattctgtaatggtcttctttgtctcttttgatctttattagtttaaagtcggttttatcagagactaggattgcaatccctgcctttttttgttttccatttgcttggtagatcttcctccatccttttatttttagcctgtgtgtgtctctgcacgtgagatgggtttcctgaatacagcacactgatgggtcttgactctttatccaatttgccagtctgtgtcttctaattggagcatttagtccatttacatttaaagttaatattgttatgtgtgaatttgatcctgtcattatgatgttaggtggttattttgttcattagttgatgcagtttcttcctagtcttgatggtctttacattttggcatgattttgcagcagcttgtaccggttgttcctttccatgtttagcgcttccttcaggagctcttttagggcaggcctgttggtgacaaaatctttcagcatttgcttgtctgtaaggtattttatttctccttcacttatgaagcttagtttggctggatatttaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttgatttctttttattcttttttctctaaacttcccttctcacttcatttcattcatttcatcttccatcaatgataccctttcttccagttgatcgcatcagctcctgaggcttctgcattcttcacgtagttcttgagccttggttgtcagctccatcactcctttaagcacttctctgtgttggttattctagttatacattcttctaaatttttttccaagttttcaacttctttgcctttggtttgaatgtcctcctgtagctcagagtaatttgatcgtctgaagccttcttctctcagctcgtcaaagtcgttctctgtccagctttgttccattgctggtgaggaactgcgttcctttggaggaggagaggcgctctgctttttagagtttccagtttttctgttctgttttttccccatctttgtggttttatctattttggtctttgatgatggtgatgtacagatgagtttttgatgtggatgtcctttctgtttgttagttttccttctaacagacaggaccctcagctgcaggtctgttggagtaccctgccgtgtgaggtgtcagtgtgcccctgctggggggtgcctcccagttaggctgctcgggagtcaggggtcagggacccgcttgaggaggcagtctgcccgttctcagatctccagctgcgtactgggagaaccactgctctcttcaaagctgtcagacagggacatttaagtctgcagaggttacagctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctgcctcagcctcactgccgccttgcagtttgatctcagactgcggtgctagcaatcagctagactctgtgggcgtaggaccctccgaagcaggtgtgggatataatctcatggtgtgccgttttttaagtccgttggaaaagcgcagtattcgggtgggagtgacccgattttccaggtgccgtccgtcacccctttctttgactaggaaagggaactccctgaccccttgcacttcccgagtgaggcaatgcctcaccccgcttcagctggcacacggtgtgcgcacccactgacctgcacccactgtctggcactccctagtgagacgaacccggtacctcagatggaaatgcagaaatcacccatcttctgcgtcactcaggctgggagctgtagaccggagctcttcctatttggccatcttggctcctccccctccataggtttttgtgtgttgtgttcccatttccattttttcaagaaatattgaaattttctttttgatttttttcactgaaccactggttgttcagctgtatgttgtctaatttccatgtatttgtagtttccaaagttcctcctcttattgatttctagttctataccattattgttgaaaaaaacattttttgatttttaattttttaatatgttaagacttttattgcagcttaacataagatatatcctggagaatgttccatgtactgtggagaagaatgtatattctgcaactactggatagaatgttctttaagcatctgttaggttcatttggtcaggagttcagtttaactctcattttttgttgatattctgtctggattatctgtttatcactgaagataagatgttcaagtgttatactattgttgtattgtacgctatatctccctgtaggcctattagcatttgctttatatatttgtatgttcaattgttgggtacatgcatatttataattgttatattctctttctgtatttacccctgtatcagtttttaattagcatatttgtctttttttacagtttttttggcttaaagtctattatgtctgatataagtatagctacttctgctccattttgctctccatttgcatggaatatctttttctatcccttcactttcagtctatttgtgttcttctgcgtaaagtgaggctcttataggcagcatatagttgagtctttaaaaaaatcaatttagctactttatgttgtttaataggaaaatttaatccatttacattcaaggtaactaccaataggtaaggaggtactactgacattttgttacttctttcctagttattttgtagatccttccttcttttctaccactcttgctatatccttttgtggttaagtgatattctccaacattatgctttgattcactgctgtttatctttagtgtatctattataggtttttactttgtggttatcatgaggctttgaaatacatattttgtttacatcaagttgttttattttattttaaatttcctacttttattttaagtccaggggtacatgtgcaggatgtataggcttattacataggaaaacgtgtgccatggtggtttactgcacagatcatcccattacccaggtattaaccccagcatccattagctattcttcctgatcttctccctcctctcatccaccacactcaggccccagtgtgtgttgctccccaccatgtgtccatgtataacaagttattttaagctaataggaacttaattttaatcagaaaagaaaggaaacaaaaatattgtacactctaactcctttcttctcaagtattttgaattttcatgtcccaatttacatcttttgtatggtttatcttttaataaagtattttagttatcatttttaagagctttgtatttttgtattcatactaaagttataagtggtttacataccataattacaatgttagatatcccaaatttatctgtattcctacatttattcatttatttaaaggcagggtcttactctatcacccaggctggagtgctgtgactcaatcttggctcactgcaacctctgcctcctaggctcaaggaattatcctatttcagcctcttgaatagctgggactacagacacaagccaccatggctggctatttattttttttctgtttttttttttttgtgtgtgtgtgttttctcgtaagatgcggttttgccatgttgcccaggctgaactcaaatccttgggttttttagtcaatccacttgcctcagctttctaaagtggtggggttacagccatgagctaccatgcctggcctgtatacttacctttaccagtgagttttataccttttgatattttcttgttacacattagcattttttttctttcaagttgaagaacttcctttgttatttcttgtaagacagatctggtggtgttgcatttacttggcttttgtttgtctggaagagcctttatctctccttcatttctgaaggacatatttgccagttactttattcttggttggcattctttttctttcagcattctgaatatattgccctacactttttggcctgcaaggtttctgctgaaaagtctgctgccaggcatatcaacattcccttacatgttatttgcttcttttctattactgcttttagaatgctctgtttttatttcgagagtcaaagggtatgtcttgaggtagttccatttgtgttgaatatgattgatggcctttgaccttcctttacttgagcatttacatctttttccaggattgtaaaattttcttttatgatttctgtgaataagccgtctatttccttgtctttttctgtaccctcttgaactccaatgacccaagtatttgctctttcaatagtatcccatagactccatgaacttcacttgtttctttttttttattctttttcccactttggccatatttcaaatagtctatcttagatttcactgatttttttttcttctgcttgattaattctgctgttaatgctcgtattgcatttcttatttcattaattgtatcttttagctctaggatttctgttagatttttcattactttagtccctgttaaacttctctgataaatttctgaactgcttttctctgtgttttactgaaattcactaagcttccttaacaagctattctgaattccttgagagataatacttctgcatcactttagggtttgtcactggcatcgtgttttgtctgtttggtgaggtcaaaattccctggttgttcttgatgcttgtgtatgtacattgatgtatttgctctgaaaaaaggtatttatttcagtcttcacagtctggctttgtttgtgcctgtttttcttcactgggcctctccagaatttaagcaaacctaatgttagatcgcatgactgctgcagccatttcagcactagaggaaactctaagcctaggttcactgtgagtctcatgagggctgtcaggttggcatggagcccttatgtagaaggacgtggtgaagacccaaggagggtgcccaagctgtgtgaggaagctggccagggacctaagtccaggagcctgtctcattggctcagatgtgggaggagctggagctgagactgggtcccctcaggatctgctttgggacaaaggctggtggtcccaccaaggagtttcagaaaaatgggtgattgcctggctatgagataagggtaagtctttctctaggtatccttgtgtgagcagtaataaactcagatcacagctgagtgggtctggagccaaattacagggtaagtttcagattcactgccaacatttaacggacagaagagattttctgccaagttattagtgtgcatgattcctcctagacacattggtagatgtttttggttcaagactcaagacaaaattggagtgtagccaagccttttgttaacaaggatgtctccaagtttgaaacctgcagtatcattggtgggtctgctatccaggtgctggtctgcaatcccaaagctgcctacctagggccttgattccactgaattttcacagattactccctgattcctgaggcttctacagagagacttttgtctgtggatgagtagataattcttggagttgggggatatgagtgggttacctcctattccaccatctttctgacatagtgtttgtatttctattctgactataacatatatagtgggattagatgaatacataattacattgattcatcggaaaccaagattttccgtgtgggagaaaagagaagtagaagtgagactgatgagttaaacacatagttttgaatttgaagtgaaagtgtaaatatgagcttgtgatgatatttatcctcaaaaaaatttccacaggctaatttttttttaggttttcccccttagaaggcctagaaactaggattaacccagtaatttccgtatcacattttttccaactaacaaggaccagagatccttgctaatttctagtgtagggcaagaagtttcggcaagaaccttgagcaactttgccacatcaggaagtaatacagtcttgatgacagaggtgtattgatggagctcaggaagaattgacttgaaaagaatctcattgtcacagataggacaatttgagcttcaataaaacaactactatgatagatacaagcatttcaaataagctgaaattcatgagtatacaattatgcaaaaaaatattgatcacttgtggagaatgccatataaagcattcattctcttgagaacgggcaaataaatagaaagaataactatcttattaccttgattccatcaaggtaataagatagttactgaagataatgtctctttaggaatattctaagtaataagtgaagaatgtttaatatatttttctttcacccctaggccattcattcataagatatgacccagggcactttgaggtccctgactccttttctgagggtccatagttcccaataaatcctaacaatactaccaggttaaatttttaattctattcttctcatgattttatgttgttctccagagactacatggaatatgatattgcatcagattggatgccaaagcagatatgaaaatgtagctgttttcttattaagccagacattaaagagaattgccaaaatactaaataaataaataaatagatgcagctgtaaagccacgcttctcactacatttttgaaaaacatttaaaaataaagatgtaatttttgttgatatgtaatccatgtttaattgtagagaagtttataaatattttaattattagtttattagtttttacttctaagatatatctagctatctgtctggacatacattttatacacacacacacacacacacacacgcacacacacaatttccatcacacagagaaaagcttttctggtgatctcaatctttttttattgtggtaaaatacacatatataagatttaccattttgccatttttaagtgtacaattctgtgttattaagtacattcacactgttgtgccaccttcaatataacttgtacatatgtaaaatgtgtaagagttgagacctattaatctagtaatgaatgaagaccattaagcattatatgcctcttgtgagatatacatagtataataaaacctgaatctgagcacatcacaaatctatttatttattttttattttttcttgagacggagtcttgctctgttgcccaagctggagtgcagtggcgcgatctcggctcactgcaagctccgcctcccgggttcatgccattctcctgcctcagcctccctgagtagctgggactacaggtgcccaccatcatgcccggctaattttttttgtagttttagtagagatggggtttcaccgtgttagccaggatggtctcaatcaactgacctcgtgatccgcccgcctcggcctcccaaagtgctgggattacaggcgtgagccaccatgcccggcccacaaatctatttatatatagtaaataaagagaacaaaggggcatgttaaatgacattatagctatgtaatcagcaaaatccaaactgtggatgattttacaagaagaatgatgaaatttcttaaaaaacaaattctaggataaaaatgagagaagaatcctacagattaaaaacggtttatgaaacatcaactaattttaatgcatgaatcttatttttattccaatttaatgaataaactgtaaaaacaattcatgagacaattggaaaaaatttgaatgctgaacaactatatatttaatgatattaagaaatcttttatttggggatgtcataatgtaatttcggctatatgttaaaaaagtctatatgttacagaaagacatgttgaaatagttaaggatgaaatgatacaatatctaaaatttattttaatcatgagttgataattttttcaaaactgtctaatgagcaaaggatagtttttatactgctttatgtttgcacatataaaattattattattattattattatttttggagacagggtcttgctctgtcacccaggctggagtgcagtggcacaatcttggctcactgcaacctccacttgctgggttcaagtgattctcctgcctcagccttccaagtagctgggactacagccatgcaccaccatgcccggctaatttttgtatttttagtagagacagatttttgccatgttggtcagcctggtctcaaactcctgacctcaggtgatccacctgcctcggcctcccaaagtgctgggattacaggcgtgagccaccacgcttggcccctataaaattattaattaatggaccagcgctggctggtccattttacagagtgcagattggtctattttacagagcactgattggtgcattttacaaacctcttgctagctacagagcactgattggtgtgtttttacagagcattgattggtgcattttacaaaactcttgctagctacagaaaagttataggagtccccactcaacccagggagtgcagctggcttcacctctcactatgaccctttaaaagctagactatagctgtagtaagccaagggtggttttctccaaaggagtttggaacagaaataaagaaaacataatattttttggctaagtggaaactattttagcaagatgaggagaatctacaatatcaactaaaaagaaaaaaaaatggaagaaagtagatgactctgaaagaaaacacttaacttggcagttacagcaactcagatagtttttactgagaaaatgaatttgcagctaagagatcttgccagagatctacaaatagggaacactgtcctcaaggaacttacaaagagaaggggaggaaaaacaaaaataactccaatgctgtgagtaaagtgtaaagtggatctctgcatagttccttttattatagcactaggaaagtcttcctgaggaagaaacatctcagctgagccttcagggctagaaattcatccaggcagagacagagaagaaattacatccaaaaggctctgcatctctgcaaatacagtgattctggcataattatatttggttttctttgacaaatgatatttaaccagaagcagaaaaagaaaagttttaaattaggaagccaaagggagtcaccattaagtcatatgtattatatttcatttattttgagacacattttttctaacattttaatgtgtgtaaaatcagggtgaatcacactgttagtacagtctcataataaatttacagttttaagtacttttttgctgatgtttaaataataatttattttaaaatacatgaaaactctgatttcatcaaatttgaaaatcatttgaaatatgataagattgacttttgggctgatatcttgggcttcttggtacttattgcgaatgggagaggagacatgatgatggctcatgggatattctgatatgacctgttaaaaacagaagaacaaaagagctccacataaaagatgtttgtacacccatgctcatagtaatattattcatgatagttaaaagtgaaagcaacccaagtgtccatagatagacgaatggatgaacaaaatgtgttatacgcatatggtggaatattgttcagtttcaaaaaaggaaggaagccctttcatatgctacaatgaggatattacgctaaatgaaataagtcacaaaaagacaaatatttacaattccacttatataaggtacctagaatagtagaattcatagagacagaatgtagagctgtcctaaccagggcctggagaagaggggaaatgggaacttgcagcgtaataggaatagagtttcagtcttgcaagacagaagagttttgaagattgcttgcacaacaatgtgaacacacttaacaccactgaactgtacacttaaaaatggtaaagatggtaaaccttatgttatgtgtattttaacagaattttttttaagtccacataaaacgaatgggagtttggggaaaggatatggtgaaaggattgaggataaacaatttttaaatagataaaatggtaaaaaacagtggaagggtgaacagaaaagacatattaaaaaaaaaaacaacaccacccacaactcaccggcgcctcatataccataatgcaaggcatagcaaaaggagcaaggaaggcactattattgccaaaacaattgagccaatggaggtggggtttcctggcaattgagagaggacaaaaggatgtcacttcagatactatacacagaattccttggccttcctttgcccacctacttccaatgtatggtcatttccaacttcctctctcatattcctggccaccatatatccatcctttgatcccctctacccagtttacaggtccttaattcctacatttttgataacttggattatctatttttactcctgttgggattggggtcagggaaatcaatcaatcaatctctccctctttcatctctcaagctctatccttccccagtgcctccctctatgcctgaagatcacttcctggcatttccagcctgggtccctgctatttcttactccagtagaggatgatgtcctggccctctaaactgctgtgcttcacccgacaggacaggccagccgcctccccatctgccacatccagggttgctcggagataccatgtccagttagcattgggcaggatgtcccctagctgagtgccctgctgctcctgctcaccccgcatccacatcacccacacgggctttgggtagaatcctgagacatggcacacaagctgcagacggccaggtccaggactggggccactggacagccaggcctcaggcttcactaaggcaggaaggagaaaaaaaagtgtcatgttataactcgagttcagaggttatgaactcagaaacctacaagcttggacagcgaccccattcactcctttgggaaccaaataacttgttatttaagctcctatcctttgatatcttcctactcttgatcttagaggaggtggtgggaagtgaaataacagcaggactaaccttgtctttgcagatctgcttttcctgcattgaggacgcccaagagatatcgggggcaggtttcatagaggagaattctcacagtttccatgataccttgatattgtatgattagtgcacagaatttctgtgccctgctgccaccttctggggaaggcacacatgaagcattcttgacactcaggaaatccaatcctcctagagctcccctcaggaagcttactatggcacctccagaatgtagctcacagcctgctatgccctggatctcaaaggggtctatgtagagggaaaagagagcaagttattaaacacaaataagaaaaaaaggcatgagaaaagaacctaggattttagattttggtggggataaagttatttggtgtaaaatgatgatgagctaaaaactaatgataacatttagacattttcagaaacaagagcattgagaaaaatgtgcatgccatgaagacaaaggtatgtgataaaggagtacagtgagtatgaaaggagaggtgaggcagagcgtggtgcagtcaggagtgcagcattccagagtgagtggaggttcccagcaagaggagggtgcggggaggagatgattgaaaagatggattaggggagaaagccacacgttagatcactcaggcacagggtaggagaagtaagggcccttgaggagaagtttcacataagacaaaccagcagctggttacaaagtggaagacagtctgagagtaagagaagagtgcagaggcagcaagaatctgaaatatgaggtgtgatggtgtgaagctggagtgagagactactcaagaaaagcatgtgcgtgcatttgggtaaaatagaaaggaagggagaagcatcagagagagcaacactttgcaaaaaagagagaaaagagagtccttgagactcttcccagttcggtggactagactcacatttcatctggaaatcaccggcaaagtcttgtacttctcgagcgaatccaaagatgtagactcggaatatctcctctaactcagcaacctccttatcactaaagttacctttagaccaaggcttcaggaatatggcagtgcctgagtcgctatcccagccatgaatctgcaaatcatccaaccagcctgagccttgagtttgtgcccaggtactattggtaaaggacgaggtctggataacatgaaaggaggtcggcccctggaaggctgtgaagagtggaaaagcaagatggtgaagataaagagagaagcaggagacaattaggaagaatgggaatgaaaatgatttagaaaacaagaacctagagtctaaagaacacaggaagtctgacacatttgactgccttaaggcttcaggttctagtcccaaccaccagaatggttgaagagggcgggagacagaaagacccagacccttagtgtccaattgcacctaggaaagccctgcttgctttttaaaatccaaacccctgcaccagtgctgggagctgccagagtgactcttaccatgttcactgttaccaccaggaaagagaacagctaacagttgaaatggcagcagcagcatttcactgggagatgcaacttcttactggcagagctggtatttgatctccaatttcagcaaagcttttcctcagtaccctgtagtgacttcttctctcttccaactgccaaatctcttcctcatccaaactgcttttcagagaaaaatgtgcctcccacagccctgagcctcttacctcaccttttatttccctcaagccctgatttttagagtttctcttaccccctgacttccagccgctctccctgtcctcaccttccttcatacctccttggaaaagcccccatatgattctgcattttcatttctccttccttagcctttattcccacatctataggataagatggtgatattaagcaattgctaagcttttagtctgctttaacccagaaggatgcttttagtttatccacctcacttagtttctccccctcccagctgccttatcttctctggcactctgttactgcctcttcccaatgttttcaatgtcttctctttcttatattgccctctttgtctggtgttccttaccccacattctaaactggctgtgagtgtgtgtgtgtgtgtgtctgtgtctgtgtgtgtatgtgtatgtgtgtgtaccgatattcacttacataaaggcaaagcatttaaaacatttcctgtactatagcactacaaaccaaaatgccagaatcaaatataataaagactgaagtttataattcaaacaaaattatactatagcaatatttgagggaaaaaatgacaattgctgctagcatgtgaccttctcttcaggagctcttggcctatggagttttgagtaacaaatattcatgacataaacagaactctaggagctatgctatgtgcacctccagcctaagtcaaagataactttttgggtaagttgccataagcggcagagcttttttcttctcttgtaatatctcataactgctgtctacatttgggcattcatatcaccacatgtggtattaataatagagcaaagaggttgcttttttttatacaaaaagttcagagatacttgttttaagatgtcacctcctatcttcttgtatgcccatgaaaaattttaagaagaatttttggattttctccatttaggaaaaaaatcacatatttgcagagatctatgtatcatgcagaaatgtggcagcaatcgattccgagtaaagagggttatcactaactaattctattatgtggataagaaaatgcaaagtgagtagtgtagtgttctctattcctggggacactactggttcacaacattaataagactggttcacaacattaataagactagccttcatccaagattattactgcctaattgataaatacagagcagctctccaaatttcaatgtatgtatctcttaacaacattcccagactccaatacatgacagaattgaatctactttttggataacagccatagacaacagcagagacttaacattggctgtcacagacatgaacattactatttttgtgtttatacgttttttattttgggtagaacacccaaaacagagctcaggaaaagctggtagacaacctgggctattttccattaaaataagtgagttcttgcaagactcccaaagttgaattgctacaaactaaatctgaaatgttcctcattttaaaaaataatccaaaagagttggcagggcacaggagactatcacaacactagccccacactcatcaaacttttttttttcttgagacagagtcttgctctgttgcccaggctggagtgcagtggcatgatctcggctcactgcagcctctgcctcttgggttcaagtgattctcctgcctcagcctcctaagtagctggaactgtaggcatgtgccactatgcccagctaatgtttgtatttttagtagagactgtgtttcaccatgttggccaggatggtcttgatctcctgaccttgtgatctgcccacctcagcctcccaaagtgccaggattacaggcatgatccaccacgcccggccactcatcaaatttttaaacaagttaggcctaaaacatgagaacagtaatccagtcaaaattatgttaccagaaaggaatattagtattgccaaagactgagttagaaattgagttgtgcctgagagatggaagatagaggaagaggtcttggtttcagtttcaacagcgtgtaagtttttgccaaatatgtgcagaatgtctacctaaataacaaacagaaaaagaggctctctaaaagaaaaagatatttatttgagaatagagcattgcaatgggaatatatatgcaatagtaaacgatgtgcatactcagggaggtaaaggaaggcaaattttttaaagaaaaaaaattaagagaattacatatttgttttgaaataattatccttgcctacaaatatcaataacaacggtgacaccagtcagaggttaaacagacagttgctggcagggcagatgtctttgaggcatttttcatgtaaggttgtgatggccttttcaaggttgtggtttttgcagagtctttcgtggtagttgttcttattaggtatacaagtgtgagaaccctctctgcatagtcttccctagctctgccagttttttttttttttccttagtgactccgttttgtttctggcaacatttgcaagaagatgactgtaaatttaaatttagttaggaaaatcgccagacaaaatgaaaattttgtaattcttcaaatgtcatatttgagggaaaaatttactttatacactgtcttttccctgaaaagtggagcaattgagatagtttgaaaggtctagaaattaaccaggttttcaagttacattctttctcacatatcatatccagtatttcatatttcctttctgtttcaaaagtacagaaatggacatggcagtgtccacagtgtccacatagcaatgtcacacatttccatactacactgtgactatgcttgtccagctctatggcatggtttgtatttccactctgcattagtaccattgttgcttgacatatgaaacctgtcttctagggaaagattatccctagtcccaatatttgtttcaaattaaaaaatcaacatgtgcacacttctaaatcgaagctttaattgatgcttctaactcatactctcctatgggcctaaagaccatgtacacttctgataagctcatcaagacacaggttttctcagatattgattgcataatctcacttatatgtggaatcttaaaagagttgagtacacagaaatagagaataaaacagtgattaccaggggcaggaagcaggtggtggtgggaggaaatgaggagatgtaggtcaaagaatacaaagtagccgatgagtagtcccttctgaattgcagaggatacattccaagacttctggtggatgcccaaaaccacaaatagtgctgaacctgattgctgccaattggagcccctttctgttcatgtcctccacccacaaatttgatggctttttaagatcttaactaagcacttaccacacactctgatcataacctttgcaatttgaggtgtgatggtaaaatttgtacaattcccttttccccatcacaattttatggaaagaagattcctttttactgtagaacatagcaacatcagcatattttgtttctttccttattaagtcaaaaacttaacaccttttcatttaaaggaagcacttaatggcttctctttggcatatttgaattacaagcatcactacttctgtgctttggggctgttattaagtaaaataagggttacttgaacacaagcactggagaccaggacagctgatctgataactgagccagctactaagtgactaagggttgggtagcatatacagtggagatatgataattaaggggtgatttgcatccttgtccagatgaagtaggctggcctgaaatttcatcatactacttagaatggtgcacaattgaaaacttatagattatttatttctggaattgcccatttaatattttcagactgccattgaccatgggtaactaaaactgtggaaaacaaaaccatgaattaaggaggggtctactgtatattataaataaaaaaatattttgaccttgctaccagtatccatgttaaattaacttattacatttaatattttatctatagatccttttggattttctaatgatatctctaaatatgaaagtttcattagatttttttcaattgttataccttttattatattttttgcccattttccctggcctatgacctccagtaaaatgataaatagaattattgatagctactttttttttttaaacagagtcttgctctgtcactcaggctggagtgcaatggtgcgatgtcagctcactgcgacctccacctcctgggttcaagcaagtctcctgcctcagcctcccaagtagctgacattacaggcatctgctaccatgtgtggctattttttttgtatttttagtagagacggggtttcactatgttggataagctggtctcaaactcctgacctcaggtgatccacctgtgttggcctcccaaagtgctgggattacaggcgtgagccaccgcacctggcccagataagattttttaagaggttaggtggttccaagatggctgaagaggaacagctccagtctatagctcccagcgtgagtgacgcagaagagggtgatttctgcgtttccaactgtggtacccggttcatctcactggggcttgtcagacagtgggtgcaggacagtgggtgtagcccaccaagcatgagacgaaacagggtgaggcatcacctcaccagggaagtgcaaggggtcagggaattcccttttcaagccaagggaagctgtgacagatggcacctggaaaatcgggtcactcccgccctaatactgagcttttccaatacttagcaaacggcacaccaggagattacatcctgcgcctggctcagagggtcccatgcccatggagcctcactcattgctagcacagcagtctgagatcgaactgcaaggctgaagcaaggatgggggagaggcacctgccattgctgaggcttgggtaggtaaacaaagtggccaggaagctcgaactgggtgtggcccaccgcagctcaaggaggcctgcctgcctctagagactccacctctgggggcggggcatagctgaacaaaaggcagcagaaacctctgcagacttaaatgtccctgtctgacagctttgaagagagtagtggttctcccagcacggagtttgagatctgagaatggtcagactgcctcctcaagtgggtctctgacccccgagtagcctaactgggaggcaccccccagcaggggcagactgacacctcacacggctgggtattcctctgagatgaagcttccagaggaacgatcaggcagcaacatttgctgttcagcaatatctgctgttctccagcctctgctgctgatatccaggcaaacagggtctggagtggacctccagcaaactccaatcaacctgcagctgagggtcctgactgttagaatgaaaactaacaaaagaaaggacatccacataaaagccccatctgtacatcaccatcatcaaagatcaaaggtagataaaaccacaaagatggggaaaaaacagagcagaaaaactggaaactctaaaattcagagcacctctctccctccaaaggaacacagctcctcaacagcaatggaacaaagctggacagagaatgactttgacaagttgagagaagaaggcttcagatgatcaaacttctcagagctaaaggaggaagttggaacccatcacaaagaagctaaaatccttgaaaaaagattagatgaatggctaactagaataaccagtttagagaagcccttaaatgacctgatggagctgaaaaccatggcacgagaactacatgacgaatgcacaagcttcagtagctgatttgatcaactggaagaaaggatatcagtgatggaagatccaatgaatgaaacaaagcaagaagagaaatttagagaaaaaagaataaaaagaaatgaatgaagcctccaagaaatatgggatgatgtgaaaagaccaaatctatgtctaactggtgtacctgaaagtgatggggacagtggaaccaagttggaaaacaatctgcaagatattatccaggagaacttccccaacctagcaaggcaggccaacattcacattcaggaaatacagataatgccacaaagatactccttgagaagagcaaccccaagacacataattttcagattcaccaaagttgaaatgaaggaaaaaatgttaagggcagccagagagaaaggtcaggttacccacaaagggaagcccatcagactaacagctgatctgttggcagaaactctgcaagccagaagagagtgggggccaatattcaacattcttaaagaaaataattttcaacccagaatttcatatccagccaaactaaggttcataagtgaaggagaaataaaatcctttatagacaagcaaatgctgagagattttgtcaccaccaggcctgccctacatgagctcctgaaggaagcactaaacatggaaaggaacaactggtaccagccacgcaaaaacatgccaaattgtaaagaccatcgatgctaggaagaaactgcatcaactaacgagtaaaataaccagctaacatcataatgacaggatcaaattcacacataacaatattaaccttaaatgtaaatgggctaaatgctccaattaaaagacacagactggaaattggataaagagtcaagacccatcagtgtgctgtattcaggagacccatctcacatacagagacacacatgggctcaaaataaagggatgggggaagatctaccaagcaaatggaaaacaaaaaaaaggcaggggttgcaatcctagtctcggataaaacagactttaagccaagaaagatcaaaagagacaaagaaggccattacataatggtaaaggggtcaatttaacaagaacagctaattatcctaaatatatatgcacccaatacaggagcacccagattcataaagcaagtccttagagacctacaaagagacttagactcccacacaataataatgggagactttaacaccccactgtagacattagacagattaacaagagagaaagttaacaaagatatccaggaattgaactcagctctgcaccaagtggacctaatcggcatctacagaactatctgccccaaaccaacagaatatacattcttctcagcaccacatcacacttattccaaaattgaccacatagttggaagtaaaggtctcctcagcaaatgtaaaagaacagaaattgttacaaactgtctctcagatcacagtgcaatcaaactagaactcagtgttaagaaactcactcaaaaccactcaactacatggaaattgaacaactggctcctgagtgactactgggtacctaatgaaatgaaggcagaaataaagatgttctttgaaaccaatgagaacaaacacacaacataccagaatctctgggaaacatttaaagcagcctgtagagggaaatttatagcactaaatgcccacaagagaaagcaagaaagatctaaaattgacatcctaatttcacaattaaaagaactagagaagcaagagcaaacacattcaaaagctagcagaaggcaagaaataactaagatcggagcagaactgaaggagatggagacacaaaaaaaccttcaaaaaatcaatgaatccaggagcttgtttttggaaaagatcaacaaaattgatagaacgctagcaagactaataaagaggaaaatagagaagaatcaaatagatgcaataaaaaatgaaaaaggggatatcaccaccaatcccacagaaatataaactgccatcagagaatactataaacacctctacgcaaataaactagaaaatctagaagaaatggataaattcctggacacatacaacctcccaagactaaatcaggaagaagttgaatctctgaacctaccaataacaggctctgaaattgaggcaataattaatagcttactgaccaaagaaagtccaggacctgacggattcacagccgagttgtaccagaggtacaaagcggagctgctaccattccttctgaaactattccaatcaatagaaaaagagggaatcctctctaactcattttatgaggccagcatcatccagataccaaaacctggcagagacacaaccaaaaaagagaattttagaccaatacctttgatgaacatcgatgcaaaaatcctcaataaaatactggcaaaccaaatccagcagcacaccaaaaagtttatccaccacgatcaagtgggcttcttccccggggtgcaaggctggttcaacatatgcaaattaataattgtaatccagcatataaacagaactaaagaaaaaaaccacatgattatctcaatagatgcagaaaaggcctttgacaaaattcaacagcccttcatgctaaaaactctcaataaactaggtatttatgggatgtatctcaaaataataaaagctatttatgacaaacccacagccaacatcatattgaatgggcaaaaattggaagcattccctttgaaaactgtcacaagacagggatgccctctttcaccactcctattcaacatagtattggaagttctggccagggcaatcaggcaggagaaagaaacaaagggtattccattaggaaaagaggaagtcaaattgttcctgtttgcagatgacatgatcgtatatttagaaaaccccatcttctcagcccaaaatatccttaagctgataaggacattcagcaaagtctcaggatacaaaatcaatgtgcaaaaatcacaagcattcctatacaccaataacagacaaacagagagtcaattcatgagtgaactcccattcacaattgcttcaaagagaataaaatacctaggaattcaacttacaaaggatgtgaaggacctcttcaagaagaacttcaaaacactgctcaatgaaataaaagaggacacaaacaaatggaagaacatttcatgctcatgggtaggaagaatcaatatcatgaaaatggccatactgcccaaggtaatttatagattcaatgccatcctcatcaaactacgagtgactttcttcacagaattggaaagaactactttaaagttcatatggaactaaagaagagcccgcattgccaagacaatcctaagccaatagaaaaaagctggaggcatcatgctaccttacttcaaagtatgctacaaggctacaataaccaaaacagcatggtactggcaccaaaacaaagacatagaccaatggaacagaacagagccctcagaaataataccacacatctacaaccatctgacctttgacaaagctgacaaaaacaagaaatggggaaaggattctctatttaataaatggctctgggaaaactgtctagccatatgtagaaagctgaaactggatcccttccttacaccttatacaaaaatcaattcaagatggactaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatcgacaatgaactcaaacaaatttacaagaaaaaaacaaacaaccccatcaaaaagtgggcgaaggatatgaacagacacttctcaaaagaagatctttatgtagccaacagacacatgaaaaaatgctcatcatcattggccatcagagaaatgcaaatcaaaaccacaaagagataccatctcacaccagttagaatggcaatcatcaaaatgtcaagaaagtacaggtgctgcagaggatgtggagaaataggaatacttttacatggttggtgggaccataaactagttcaaccattgtggaagtcagtgtggcgattcctcaaggatctagaactagaaataccatttcaccaagccatcccattacttgctatatacccaaaggattataaatcgtgctgctataaagacacatgcacacatatgtttattgtggcactattcacaatagcaaagacttggaaccaacccaaatgtccatcagtgatagactggattaagaaaacgtggcacatatacaccatggaatactatgcagccataaaaaatgatgagttcatgtcctttgtag

SEQ ID NO: 12766 - DNA, 6181 bp, Homo sapiens
ttctttttttattatttattattattattattatcatactttaagttttagggtacatgtgcacaatgtgcaggttagttacatatgtatacatgtgccatgatggtgtgctacacccattaaatcgtcatttagcattaggtatatttcctaatgctatccctccccactccccccaccccacaacagtccccagagtgtgatgttccccttcctgtgtccatgtgttctcattgttcaattcccatctatgagtgagaacatgcggtgtttggtgttttgttcttgcgatagtttactgagaatgatgatttccaatttcatccatgtccctacaaaggacatgaactcatcattttttatggctgcatagtattccatggtatatatgtgccacattttcttaatccagtctatcactgttggacatttgggttggttccaagtctttgctattgtgaatagtgcagcaataaacatacgtgtgcatgtgtctttatagcagcatgatttatagtcctttgggtatatacccagtaataggatggctgggtcaaatggtatttctagttctagatccctgaggaatcaccacactgacttccacaatggttgaactagtttatagtcccaccaatagtgtaaaagtgttcctatttctccacatcctctccagcacctgttgtttcctgactttttaatgattgacattctaactggtgtgagatggtatctcattgtggttttgatttgcatttctctgatggccagtgatgatgagcattttttcatgagtcttttggctgcataaatgtcttcttttgagaagtgtctgttcatatcgtttgcccactttttcatggggttgtttgtttttttcttgtaaatttgtttgagttcattgtagattctggatattagccctttgtcagatgagtaggttgtgaaaattttctcctattttgtaggttgcctgttcactctgatggtagtttctcttgctgtgcagaagctctgtagtttaattagatcccatttgtcaattttggcttttgttgccaatgcttttggtgttttagacatgaagtccttgcccatgcctatgtgctgaatggtaatgcctaggttttcttctagggtttttatggttttatgtctaacatgtaagtctttaatccatcatgaattaatttttgtataaggtgtaaggaagggatcgagtttcagctttctacatatggccagccagttttcccagcaccatttattaaataggaaatcctttccccattgcttgtttttctcaggtttgtcaaagatcagatagttgtagatatgcggcattatttctgagggctctgatctgttccattgatctatatctctgttttggtatcagtaccatgctgttttggttactgtaaccttgtagtatagtttgaagtcaggtagcgtgatgcctccagatttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatagaatgttcttccatttgtttgtatcctcttttatttcattgagcggtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacgttgattttgtatcctgagactttgctgaagttgcttatcaacttaaggagattttgggctgagacagtggggttttctagatgtacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgcccattcagtatgatattggctgtggttttgtcatagatagctcttattattttgagatacgtcccatgaatacctaatttattgagagtttttagcatgaagtgttgttgaattttggcaaaggccttttctgcatctattgagataatcatgtggtttttgtctttggttctgtttatattctggattacatttattgatttgcgtatattgaaccagccttgcatcccagggatgaagctcacttgatcatggtggataaggtttttgatgtgctgctggattcagtttgccagtattttattgaggatttttgcatcaatgttcatcaaggatattggtctaaaattctcttttttggttgtgtctctgcaaggctttggtatcaggatgatgctggcctcataaaatgagttagggaggattccctctttttctattgatcggaatagtttcagaaggaatgttaccagttcctccttgtacctctggtagaattcggctgtgaatccatctggtcctggactctttttggttggtaagctattgattattgccacaatttcagatcctgttattggtctattcagagattcaacttcttcctgatttagtcttgggagagtgtatgtttcgaggaatttatccatttcttctagattttctagtttatttgcgtagaggtgtttgtagtattctctgatggtagtttgtatttctgtgggatcggtggtgatatcccctttatcattttttattgcatctgtttgattcttctttttttctttattagtcttgctagcggtctatcaattttgttgatcctttcaaaaaaccggctcctgaattcattaattttttgaagggttttttgtgtctctatttccttcagttctgctctgattttagttatttcttgcctcctgctagcttttgaatgtgtttgctcttgcttttctagttcttttaattgtgatgttagggtgtcaattttggatcttttctgctttctcttgtgggcatttagtgctataaatttccctctacacactgctttgaatgtgtcccagagattgtgttatgttgtgtctttgttcttgttggtttcaaagagcatctttatttctgccttcatttcgttatgtacccagtagtcattcaggagcaggttgttcagtttccatgtagttgagtggttttgagtgagtttcttaatcctgagttctagttggattgcactgtggtctgagagacagtttgttataatttctgttcttttacatttgctgaggagagctttacttccaagtatgtggtcaattttggaataggtgtggtgtggtgctgaaaaaaaagtatattctgctgatttggggtggagagttctgtagatgtctattaggtccgcttggtgcagagcttagttcaattcctgggtattcttgttaacttcctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttgatttaaagtctgttttatcagagactaggattgcaacccctgcctttttttcttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttgtgtgtgaatttgatcctgtcattatgatgttagctggttattttgcttgttagttgatgcagtttcttcctagtctcgatggtctttacattttggcatgattttgcagtggctggtaccggttgtgcctttccatgtttagtgcttccttcaggatctcttttagggcaggcctggtggtgacaaaatctctcagcatttgcttgtctgtaaagtattttatttctccttcacttgtgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccgacctttctttctggctgcccttaacattttttccttcatttcagctttggtaaatctgacaattatgtgtcttggagttgctcttctcgaggagtatctttgtggcattctctgtatttcctgaatctgactgttggcctcccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttctattcttttttctctaaacttcccttctcgcttcatttcattcatttcatcttccatcgctgataccctttcttccagctgatcacattggctcctgaggcttctgcattcttcacgtagttctcgagccttggctttcagctccatcagctcctttaagcacttctctgtattggttattctagttatacattcgtctaaatttttttcaaagtttttaacttctttgcctgtggtttgaatttcatcctgtagctcggagtagtttgatcgtctgaagccttcttctctcaactcgtcaaagtcattctccgtccagctttgttccgttgctggtgaggaactgcgttcctttggaggaggagaggcactctgctttttagagtttccagtttttctgctctgttttttccccatctttgtggttttatctcctgttggtctttgatgatggtgatgtacagatgggtttttggtgtggatgtcctttctgtttgttagttttccttctaacagacaggaccctcagctgcaggtctgttggagtttgctagaggtccactccagaccgtttgcctgggtatcagcagcagtggctgcagaacagcagattttcgtgaaccacgaatgctgctgtctgatcgttcctctggaagttttgtctcagaggagtacccggccgtgtgaggtgtcagtctgcccctactgggggatgcctccccgttaggctgctcaggggtcaggggtcagggacccacttgaggaggcagtctgcccattctcagatctccagctgtgtgctgggggaaccactgctctcctcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcgagcctgggcaatggcgggcacccctcccgcagccttgctgccgccttgcagtttgatctcagactgctgtgctagcaatcagggagactccgtgggcgtaggaccctccgagccaggtgcaggatataatctcctggtgcgccgtttcctaagcctgtcggaaaagcgcagtattcgggtgggagtggcccgatgttccaggtgccgcctgtcacccctttccttgaccaggaaaggggactccctgaccccttgcgcttcccgagtgaggcaatgcctcgccctgcttcatctggcgcatggtgcgctgcacccactgtcctgcgcccactgtctggcactccctagtgagatgaacccggtacctcagatggaaatgcagaaatcacccgtcttctgcgtcactcatgctgggagctgtagaccggagctgttcctattcggccatcttggctcctcctcctccaaa

SEQ ID NO: 12767 - DNA, 6067 bp, Homo sapiens
tttttttttttttttaattaatgtatttgtttatttatttattgttattatactttaagttttaggatacatgtgcacaatgtgcaggttagttacatatgtatacatgtgccatgctggtgcgctgcacccactaactcgtcatctagcattagttatatctcccagtgctatccctcccccctccccccaccccacaacagtccccagagtgtgatgttccccttcctgtgtccatgtgttctcattgttcaattcccacctatgagtgagaatatgtggtgtttggttttttgttcttgcgatagtttactgagaatgatgatttccagtttcatccatgtccctacaaaggacatgaactcatcgttttttatgactgcatagtattccatggtgtatatgtgccaattttcttaatccagtctatcattgttggacatttgggttggttccaagtctttgctattgtgaataatgccccaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtaactcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtagattgcaaaaattttctcccattctgtaggttgcctgttcactatgatggtagtttcttttgctgtgcagaagctctttagtttaattcaatcccattggtcaattttggcttttgttgccattgcttttggtgttttagacatgaagtccttgcccatgcctatgtcctgaatggtaatgcctaggttttcttctagggttttcatggttttaggtctaacgtttaagtctttaatccatcttgaattgatttttgtataatttgttaaggaagggatccagtttcagctttctacttatggctagccagttttcccagcaccatttattaaatagagaatcctttccccgttgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccctgggcagtatggccatttccacgatattgattcttcctacccatgagcatggaatgttcttccatttgtttgtgtcctcttttatttccttgaagagtggtttgtagttctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatccacttaaagagattttgggctgagacaatggggtcttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattatgttgaaatacatcccatcaatacctaatttattgagagtttttagcatgaaggttgttgaattttgtcaacagtctcttctgcatctattgagataatcatgtggtttttgtctttggctctgtttatatgctggattacatttattgatttgcgtatattgaaccagccttgcatcccagggatgaagcccacttgatcatggcggataagctttttgatgtgctgctggattcggtttgccagtattttattgaggatttttgcatcaatgttcatcaaggatattggtctaaaattctcttttttcattgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatatcccctttatgattttttattgcgtctattagattcttctctctttttttctttattagtcttgctagtggtctatctattttgttgatcctttcaaaaaaccagctcctggattcattaattttttgaagggttttttgtgtctctatttccttcagttttgctctgattttagttatttcttgccttctgctagcttttgaatgtgtttgctcttgcttttctagttcttttaattgtgatgttaggatgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattgtgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttataaatctgggtgcttctgtattgggtgcatatatatttaggatagttagctcttcttgttgaattgattcctttaccattatgtaatggccttctttgtctcttttgatctttgttggtttaaagtctgttttatcagagactagtattgcaacctcttcctttttgtgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttaaatttaaagttaatattgttatgtgtgaatttgatcctgtcattatgatgttagttggttattttgctcgttagttgatgtagtttcttcctagtctcaatggtctttacattttgtcatgattttgcagcagctggtaccggttgttcctttccatgtttagcgcttccttcaggagctcttttagggcaggcctggtggtgacaaaatctctcaacaattgcttgtctgtaaagtattttatttctccttcacttatgaagcttagtttggctggatatgaaattctgggttgaaaattcttttctttaagaatgttgaatattggcccccactcttttctggcttgtagagtttctgccgagagatccactgttagtctgatgggcttccctttgaaggtaacccgacctttgtctctggctgcccttaaccttttttccttcatttcaactttggtgaatctgacaattatgtgtcttggagttgctcttctcgaggagtatgtttgtggcgttctctgtatttcctgaatctgaatgttggcctgccttgctagattggggaagttctcctggatgatatcctgcagagtgttttccaacttggttccattctccccgtcactttcaggtacaccaatcagacgtagatttggtcttttcacatagtcccatatttcttggaggctttgctcgtttctttttattcttttttctctaaacttcccttctcgcttcatttcattcatttcatcttccatcactgaaaccctttcttccagttgatcgcatcggctcctgaggcttctgcattcttcacgtagttctcgagccttggttttcagctccatcagctcctttaagcacttctctgtattggttattctagttagacattcttctaaatttttttcaaagttttcaacttctttgcctttggtttgaatgtcctcccgtagctcagagtaatttgattgtctgaagccttcttctctcagctcgtcaaagtcattctccgtccagctttgttctgttgctggtgaggaactgcattcctttggaggaggagaggcgctctgctttttagagtttccagtttttctgctctgttttttccccatctttgtggttttatctacttttggtctttgatgatggcgatgtacagatgggtttttggtgtggatgtcctttctgtttgttagttttccttctaacagacaggaccctcagctgcagatctgttggaatacccagccgtgtgaggtgtcagtctgcccctgctgggggatgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcctgcagaggtggagcctacagaggcaggcaggcctccttgagctgtggtgggctccacccagttcgagcttccgggctgctttgtttacctaagcaagcctgggcaatggcgggcgcccctcccccagcctcgctgccgccttgcagtttgatctcagactgctgtgctagcaatcagcaagactccgtgggcgtaggaccctccgagccaggtgcgggatataaactcccggtgcaccgttttttaagcccgtcggaaaagcgcagtattcgggtgggagtgacccgattttccaggtgccgtctgtcacccctttctttgactaagaaagggaactccctgaccccttgcacttcccgagtgaggcaatgcctcgccctgcttcggctggcgcacagtgcgcgcacccactgacctgcgcccgctgtctggcactccctagtgagatgaaccgggtacctcagacggaaatgcagaaatcacccttcttctgcgtcgctcacgctgggagctgtagaccggagctgttcctattcagccatcttggctcctccctccc

SEQ ID NO: 12768 - DNA, 6041 bp, Homo sapiens
tgccattttttttctattattatactttaagttttagggtacatgtgcacattgtgcaggttagttacatatgtatacatgtgccatgctggtgcgctgcacccactaactcgtcatctagcattaggtatatctcccagtgctatccctccccgctccgcgcaccccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttacagtcctttgggtataaacccagtaatgggatggctgggtcaaatggtatttctagttctagatccctgaggaatcgccacactgacttccacaatggttgaactagtcttacagtcccaccaacagtgtaaaagtgtctccttatttctccacatcctctccagcacctgttgtttcctgactttttaatgattgccattctaactgatgtgagatggtatctcattgtggttttgatttgcatttctctgatggccagtgatgatgagcattttttcacgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttttaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggccagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaacatgctgttttgattactgtagccttgtagtatagtttgaagtcaggtagtgtgatgcctccagctttgttcttttggcttaggattgacttggcaatgcgggctcttttttggttccatatgaactgtaaagtagttttttccaattctttgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggattgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagatttggggctgagacaatggggttttctagatatacaatcatgtcgtctgcaaatagggacaatttgacttcctcttttcctaattgaataccctttatttccttctcctgcctgattgccctggccagaacttccaacactatgttgaataggagtggagagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagcgttgttgaattttgtcaaaggccttttctgcatctattgagataatcatgtggtttttgtctttgtttctgtttatatgctggattacatttattgattttcgtatattgaaccagccttgcatcccagggatgaagcccacttgatcatggtggataagctttttgatgtgctactggattcgttttgccagtattttattgaggatttttgcatccatgttcatcgaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtatctctggtagaattcggctgtgaatccatctggtcctggactctttataaaaaggtaagctattgattattgccacaatttcacatcctgttattggtctattcagagattcaacttcttcctggtttagtcttgggagggtgtatgtgtccaggaatttatccatttcttctagattttctagtttccttgcgtagaggtgtttgtagtattctctgatggtagtttgtatttctgtgggattggtggtgatatctcctttatcattttttattgcgtctatttgattcttctctctttttttattagtcttgctagcagtctatcaattttgttgatcctttcaaaaaaccagctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttgaatctttcctgctttctcttgtgggcatttagtgctataaatttccttctacacactgctttgaatgtgtcccagagattctggtatgttgtgtctttgttctcgttggtttcaaagaacatctttatttctgccttcatttcgtgatgtacccagtagtcattcaggagcaggtttttcagtttccatgtagttgagcagttttgagtgagattcttaatcctgagttctagttggattgaactgtggtctgagagatagtttgttataatttctattcttttacatttgccgaggagagctttacttccaactatgtggtcaattttggaataggtgtggtgtggtgctgaaaaaaatgtacattctgttgatttggggtggagagttctgtagatgtctattaggtctgcttggtgcagagctgagttcaattcctgggtgtccttgttgactttctgtctctttgatctgtctaatgttgacagtggggtgttaaagtctcccattattaatgtgtgggagtctcagtctctttgtgggtcactgaggacttgctttatgactctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcatttttttttttccatttgcttggtagatcttcctccacccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgcctgtaaaggatgttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagtggatcgcatcggctcctgaggcttctgcattcttcacgtagttctcgagccttggttttcagctccatcagctcctttaagcacttctctgtattggttattttagttatacattcctctaaatttttttcaaagttttcaatttctttgcctttggtttgaatgtcctctcatagctcagagtaatttgattgcctgaagccttcttctctcagctcatcaaagtcattctctatccggctttgttccgttgctgatgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacctggccatgtgaggtgtcagtgtgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggccgccttgagctgtggtgggctccacccagttggagcttctcggctgctttgtttacctaagcaagcctgggcaatggcgggcgcccctcccccagcctcgctgccgccttgcatttgatctcagactgctgtgctagcaatcagcgagactccgtgggcgtaggaccctcccagccaggtgcgggatataatctcgtggtgcgccgttttttaagcccgtcggaaaagcgcagtattccggtgggagtgacccgattttccaggtgccgtctgtcacccctttctttgactaggaaagggaactccctgacccctcgcacttcccgagtgaggcaatgcctcgccctgctttggctcgcacacggtgtgctgcacccactgacctgcgcccactgtctggcactccctagtgagatgagcccggtacctcagatggaaacgcagaaatcacccgtcttctgcattgctcacgctgggagctgtagaccggagctgttcctattcggccatcttggctccagccacctcc

SEQ ID NO: 12769 - DNA, 4911 bp, Homo sapiens
ttttttttaaattatactttaagttctagggtacatgtgcataatatgtaggtttgttacatatgtatacatgtgccatgttggtgtgctgcacccattaacttgtcatttacattaggtatatctcctgatgctatccctcccccgtgctgccaccccatgacaggccccggtgtgtgatattccccaccctgtgtccaagtgttctcattgttcaattcccacctatgagtgagaacatgcggtgtttggttttctgtccttgcaatagtttgctgagaatgatggtttccagcttcatccatgtcccagaaaggacatgaactcatccttttttatggctgcatagtattccgtggtgtatatgtgccacattttcttaatccagtctatcattgttggacatttgggttggttccaagtctttgctattgtgaataatgccacaataaacatacgtgtgcgtgtgtctttatagcagcatgatttttaatcctttcggtatatacccagtaatgggatggctgggtcaaatggtatttattgttctagatccttgaggaatcaccacactgtcttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgattttcatttctctgatggccagtgataatgagcattttttcatgtgtctgttggctgcataaatgtcttcttttgagaagtgtctgttcatatccttcgcccactttttgatggggttgtttgatttttttcttgtaaatttgtttaagttctttgtagattctggatattagtcctttgtcagatgggtagattgaaaagttttctcccattatgtaggttgcctgttcactctgatggtagtttcatttgctgtgcagaagctctttagtttaattagatcccatttgtcaattttggctttgttgccattgcttttggtgttttagtcatgaagtccttgcacatgcctatgtcctgaatggtatggcttaggttttcttctagggtttttatggttttaggtctaacatttaagtctttaatccatcttgaattaatttttgtataaagtgtaaggaagggatccagtttgagctttctacatgtagctagtcagttttcccagcaccatttattaaatagggaatcctttccccagttcttgtttttctcaggtttgtcaaagatcagatggttgtagatgtgtgacattatttctgagggctctgttctgttccattggtctgtatctctgttttggtaccagtaccatgctgttttggttactgtagccttgtagtatagtttgaagtcaggtagcatgatgcctccatctttgttcttttggcttagggttgtcttggcaatgccggctcttttttggttccatatgaactttaaagtagttttttccaattctgtgaagaaagtcattggtagcttgatggggatggcattgaatctataaattaccttgggcagtatggccattttcacgatattcattcttcctatccatgagcatggaatgttcttccatttgtttgtgccctcttttatttcactgagcagtggtttctagttctccttgaagaggtccttcacatcctttgtaagttggattcctaggtattttattctctttgaagcaattgtgaatgggagttcactcatgatttggctctctgtttgtctgttattggcgtataggaatgcttgtgatttttgcacattgattttgtatcctgagattttgctgaagttgcttatgagcttaaggagattttgggctgagacgatgggattttctaaatatacaatcatgtcatctgcaaacagggacaacttgacttcctcttttcctaattgaatacactttctttctttctcctgcctgattgccctggccagaacttccaacactatgttgaataggagtggtgagagagggcatccctgtcttgtgccagttttcaaagggaatgcttccagtttttgcccatttagtatgatattagctgtgggtttgtcataaatagctcttataattttgagatacgtcctatcaatacctagtttatttagtgtttttaacatgaagtgctgttgaattttgtcgaaggccttttctgcatcttttgagataatcatgtggtttttgtctttggttctgtttatatgatggattacatttattgatttgcatatgttgaaccatccttgcatcccagggatgaagcccacttgatcatggtggataagctttttgatgtgctgctggatttggtttgccagtattttattgaggatttttgcatcaatgttcatcagggatattggtctaaaattctctttttttgttgtgtctctgccaggctttggtatcaggatgatactggtctcataaaatgagttaggagagattccctctttttctatttattggaagtttcagaaggaacggtaccagctcctctttgtacctccggtagaatttggctgtgaatccatctggtcctggactttttttggttggtaggctctgaattattgcctcaatttcagagcctgttattagtctattcagggattcaacttcttcctggtttagtcttgggatggtgtacgtgtccaggaattcatccatttcttctagattttctggtttatttgtgtagaggtgtttatagtattctctgatggtagtttgtatttctgtggcatcagtagtgatatcccctttatcattttttattgcgtctatttgattcttctctcttttcttctttattggtcttgctagcagtctatcaattttgttgatcttttcaaaaaaccagctcctggatttactgattttttgaagggttttttgcgtctctatctccttcagttctgctctgatgtttgttatttcttgccttctgctagcttttgaatgtgtttgctcttgcttctctagttcttttaattgtgatgttagggtgtcaattttagatctttcctgctttctcttgtgggcattcagtgctataaatttccctctacacactgctttgaatgtgtcccagagattctggtatgttgtgtctttgttctcatcggtttcatagaacatctttatttctgccttcatttcgttatgtacccagtagtcattcaggagcaggttgttccagtttccatgtagttgagcggttttgagtgagtttcttaatcctgagttctagtttgattgcactgtggtctgagagacagtttgttataatttctgttcttttgtatttgctgagtagtgctttacttcccactatgtggtcagttttggaataagtgcaattggtgctgagaagaatgtatattctgttgatttgggatggagagttctgtagatgtctgttaggttcacttggtgtagagctgtgttcaggtcctggatatccttgttaattttctgtcttgttgatctgtctaatgttgacagtggggtgttgaagtctcccattattattggatgggagtctcagtctctttgtaggcctctaaggacttgttttatgaatctgggtgctcctgtattgggtgcatatatatttaggatagttagctcttcttgttgaattgatccctttaccattatgtaatggccttctttgactcttttgatcgttattggtttaaagtctgttttatcagagactaggattgcaacccctgcttttttttgttttccatttgcttggtagatcttcctccatccgtttattttgagcctatgtgtatgtctgaaagtgagatgggtctcctgaatacagcacactgatgagtcttgactctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagcatcgatgatctttacaatttggcatgttgttgcagtggctggtaccagttgttcctttccatgcttagtgcttccttcaggagctcttgtaaggcaggcctggtggtgacaaaatctctcagcatttgtttgtctgtaaagtattttatttctccttcacttatgaagcttagtttggctggatatgaaattctgggttgaacattcttttctttaaggatgttgaatattggcccccactctcttctggcttgtagagtttgtgctgagagatcagctgttagtctgatgggcttccctttgtgggtaacctgacctttctctctggctgcccttaacattttttccttcatttcaactttggtgaatctgataattatgtgtcttggagttgctcttctcgaggagtatctttatggcattctctgtatttcctgaatttgaatgttggcctgccttgctagattggggaagttctcctggataatatcctgcagagtgttttccaacttggttccattctccccgtcactttcaggtacaccaatcagacgtagatttggtcttttcacatagtcccatatttcttgaaggctttgtttgtttctttttattcttttttctctaaacttctcttgtctctgtatttcattcatttgatcttcaatcagtgataccctttcttccacttgatcaaatcggctactgaagcttgtgcattcgtcacatagttcttgtgtcatggttttcagctccatcaggtcatttaaggtcttctctaggctgtttattctagttagtcattcgtctaatctttttta

SEQ ID NO: 12770 - DNA, 5558 bp, Homo sapiens
gatttagttattttttttttattattatactttaagttttagggtacatgtgcacaacgtgcaggttagttacatatgtatacctgtgccatgctggtgtgctgcacccatcaacccgtcatctaacattagatatatctcccagtgctatccctcctgcctcccccgaccccacaacagtccccagagtgtgatgttccccttcctgtgtccatgtgttctcattgttcaattcccacctatgagtgagaacatgcgacatttggttttttgtccttgtgatagtttgctgagaatgatggtttccagcttcatccatgtccctacaaaggacatgaactcatcatttcttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttataatcctttgggtatatacccagtaaagggattgctgggtcaaatggtagttctagttctagatccctgaagaatcgccacactgacttccacagtggttgaactagtttacagttccaacagcagtgtaaaagcgttcctgtttctccacatcctctccagcacctgttgtttcctgactttttaatgattgccattctaactggtgtcagatggtatctcactgtggttttgatttgcatttctctgatggccagtgatgatgagcattttttcatgggtctgttggctgcataaatgtcttcttttgagaagtgtctgttcatgtccttcgcccactttttgatggggttgtttttttcctgtaaatttgtttgagttcattgtagatgctggatattagccctttgtcagatgagtagattgcaaaaatgttctcccattctgtaggttgcctgttcactctgatggtagtttcttttgctgtgcagaagctctttagtttaattagatcccatttgccatttttgtcttttgttgccattgcttttggtgttttagacatgaagtccttgcccatgtctctgtcctgaatggtattgcctaggttttcttctagggtttttatggttttaggtctaacatgtaagtctttaatccatctcgaattaatttttgtgtaaggtgtaaggaagggatccagtttcagctttctacatatggctagccagttttcccagcaccatttattaaatagggaatcctttccccatttcctgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagcgtgatgcctctagctttgttcttttggcttaggattgacttggcaatgcgtgctcttttctcgttccatatgaactttaaagtagttttttccaattctgtgaagaaagtcactggtagcttgatagggatggcattgaatctataaattaccttgggcagtatggccattttgacgatattgattcttcctacccatgagcatggaatgttcttccatttgtttgcatcctgttttatttcattgagcagtggtttgtagttctccttgaagaggtccttcacatcccttgtaagttggattcctaggtattttattctctttgaagcaattgtgaatgggcgttcactcatggtttggctctctgtttgtctgttattggtgtataagaatgcttgtgatttttgcacattgattttctatcctgagactttgctgaagttgcttatcagcttaaggagattttgggctgagacgatggggttttctagatatacaatcatgtcatctgcaaacagggacaatttgacttcctcttttcctaattgaataccctctatttccttctcctgcctcattgcactggtcagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccaacagtaccgaatttattgagagttgttagcatgaagcgttgttgaattttgtcaaaggccttttctgcatctattgatataatcatgcggtttttgtctttgtttctgtttatatgctggattacgtttattgatttgtgtatgttgaaccagccttgcatcccagggatgaagcccacttgatcatggtggataagctttttcatgtgctactgtatttggtttgccagtattttattgaggatttttgcatcgatgtttatcagggatattggtctaaaattctctttttttgttatgtctctgcccggctttggtatcaggatgatgctggcctcataaaatgagttagggaggtttccctctttttctgttgattggaatagtttcagaaggaatggtaccagctcctccttgtacctctggtagaattcggctgtgaatccatctggtcttagactttttttggttggtaagctattaattattatctcaatttcagagcttgctattggtctcttcagagattcaacttcttcctggcttagtcttgggagggtgtatgtgtcgaggaatttatctatttcctctagattttctagtttatttgtgtagaggtgtttatagtattctctgacggtagtttgtatttctgtgcgattggtggtgatatcccatttatcattttttattgtgtctatttgattcttctctcttttcttctttattagccttgctagcggtctatcaattttgttgatcgtttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcatttttagatctttcctgctttctcttgtgtgcatttagtgctataaatttccctctacacactgctttgaatgtgtctcccagagattctggtgtgttgtgtctttgttctcgttggtttcaaagaacatctttatttctgccttcatttcattatgtacccagtagtcattcaggagcaggttgttcagttttgatgtagttgagtggttttgaagtgagtttcttaatcctgagttctagtttgattgcactgtggtctgagagacagtttgttctaatttctgttcttttacatttgctgaggagagctttacttccaagtatgtggtcaattttggaatacgtgtggtgtggtgctgaaaagaatgtatattctgttgatttggggtggagaggtctgtagatgtctattaggtccacttggtgcagagctgagtttatttcctggatatccttgttaactttctgtcttgttgatctgtctaatgttgacagtggggtgttaaagtctcccattattattgtgtgggagtctaagtctctttgtaggtctctaaggacttgccttacgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcagcccctgcctttttttgttttccatttgcttggtagaccttcctccatccctttattttgagcctatgtgtgtctctgcacgtgagatgggtttcctgaatacagcacactgatgggtcttgactctttatccagtttgccattctgtgtcttttaattgcagcatttagcccatttacatttaaggttaatattgttatgtgtggatttgatcctgtcattatgatgttagctggttagtttgctcgttagttgatgcagtttcttcctagcctcgatggtctttacaatttggcatgtttttgcagtggctggtaccggttgttcctttccatgtttagtgcttcttcaggagctcttttagggcaggcctggtggtgacaaaatctctcagcatttgcttgtctgtaaagtattttatttctccttcatttatgaaacttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaaccttttttccttcatttcaactttggtgagtctgacaattatgtgtcttggagttgctgttctcgaggagtatctttgtggcgttctctgtattgcctgaatctgaacgttggcctgccttgctagattggggaagttctcctggataatatcctgcagagtgttttccatcttggttccattctccccgtcactttcatgtaccgcaatcggatgtagatttggtcgtttcagatagtcccatatttcttggaggctttgttcgtttctttttattcttttttctctaaagttctcttctcgcttcatttcattcttttcgtcttccatcgctgataccctttcttccagttgatcgaatcagctactgaggcttgtgtattcgtcacgtggttctcgtgccgtggttttcagctccatcaggtcctttaaggacttctctgcattggttattctagttagccattcgtctaatcttttttcaaggtatttaacttctttgtcatgggtttgaacttcctcctttagctcggagtagtttgattgtctgaagccttcttctctcaacctgtcaaagtcattctctgtgcagctttgttccgttgctggtgaggaactgcgttcctttggaggaggagaggcactctgatttttagaattttcagtttttctgctctgtttttttccccatctttgtgcttttacctacctttggtcttagatgatggtaacatacagatggggttttggtgtggatgtcctttctgtttgttagttttccttctaacagtcaggaccctcagctgcaggtctgttggagtttgctggaggtccactccagaccctgtttgcctggatatcagcagcggaggctgcacaacagcggatattggtgaacagcaaatgttgctgcctgatcattcctctggaagttttgtctcagaggagtacccggccgtgtgaggtatcagtctgcccctactggggggtgcctcccagttaggctactcggggtcagggacgcacttgaggaggcagtctgtccgttctcagatctccagctatgttctgggagaaccactactctcttcaaatctgtcagacagggacattt

SEQ ID NO: 12771 - DNA, 6038 bp, Homo sapiens
ccttagtagaattcctttttttttttaattatacttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtaatattctccttcctgtgtccatgtgatctcattcttcaattcccacctatgagtgagaatatacggtgtttggttttttgttcttgtgatagtttactgagaatgatgatttccaatttcatccatgtccctacaaaggacaagaactcatcatcttttatggctgcatagtattccatggtgtatatgtgccacattttcttaatccagtctatcattgttggacattggggttggttccaagtttttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgacgatgagcattttttcatgtgttttttggctgcataaatgtcttcttttgagaagtgtctgttcatgaccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgtgtgcagaagctctttagtttaattagatcccatttgtcaattttggcttttgttgccattgcttttggtgttttggacatgaagtccttgcccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggtgttatttcttagggctctgttctgttccattgatctatatctctgttttggtaccagtaccatgctgttttcgttactgtagccttgtagtacagtttgaagtcaggtagtgtgatgcctccagctttgttcttttggcttaggattgccttggcgatgcaggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctcttggaagcaattgtgaatgggagttcactcatgatttggctctctgtttgtctgtttttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactattgaataggagtggtgagagagggcatccctgtcttgtgccagttttcaaagggaatgcttccagtttttgcccattcagtatgatattggctgtggggttgtcatagatagctcttattattttgaaatacgtcccatcaatacctaatttattgagagtttttagcgtgaagcgttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcctggctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaccagctcctggattcattaatttgttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatgtctgttcttttacatttgctgaggagagctttacttccaagtatgtggtcaattttggaataggtgtggtgtggtgctgaaaaaaatgtatattctgttgatttgggagggagttctgtagatatctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttatattgagcctatgtgtgtctctgcacgtgagatgggattcctgaatacagcacactgatgggtcttgactctttatccaatttgccagtctgtgtcttttaattggagcatttagcccatttacatttaaagttaatattgttatgtgtgaatttgatcctgtcattatgatgttagctggtgattttgctcgttagttgacgcagtttcttcctagtcttgatggtctttacattttggcttgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaagtcttttttttaagaatgttgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtattggagttgctcttctcgaggagtatctttgtggcgttctctgtatttcctgaatctgaacgttggcctgccttgctagattgggaagttctcctggataatatcctgcagagggttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttctagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgcagctcagagtaatttgatcgtctgaagccttctcccctcagctcgtcaaagtcattctccgtccagctttgttccgttgctggtgaggagctgcgttcctttggaggaggagaggcgctctgatttttagagtttccagtttttctgttctgtttgttccccatctttgtggttttatctacttttggtctttgatgatggtgatgtacagatgggtttttggtgtggatgtcctttctgtttgttagttttccttctaacagagaggaccctcagctgcaggtctgttggaataccctgctgtgtgaggtgtcagtgtgcccctgctggggagtgcctcccatttaggctgctcgggggtcaggggtcagggacccacttgaggcagtctgcccgttctcagatctccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacctagttcgagcttcccagctgctttgtttacctaagcaagcctgggcaatggcgggcgccactcccccagcctcgctgccgccttgcagtttgatctcagactgctgtgctagcaatcagtgagactccgtgggcgtaggaccctccgagccaggtgcgggatgtaatcttgtggtgcgccgttttttaagccggtccgaaaagcacaatattcggatgggagtgacccgattttccaggtgcgtccgtcacccctttctttgactcggaaagggaactccctgacgccttgcgcttcccaagtgaggcaatgcctcgccctgtttcggctcgcacacggtgcgcgcacccactgacctgcgcccactgtctggcactccctagtgagatgaacccggtacctcagatggaaatgcagaaatcacccgtcttctgcatcactcatgctgggagctgtagaccggagctgttcctatccggccatcttttttccgaattc

SEQ ID NO: 12772 - DNA, 6461 bp, Homo sapiens
tttatttttttatttatttttttattattattattactattattattattattttttaattatactttaagttttagggtacatgtgcacattgtgcaggttagttacatatgtatacatgtgccatgctggtgtgctgcacccactaactcgtcatctagcattaggtatatctcccaatgctatccctcccccctcccccctccccaccacagtccccagagtgtgatattccccttcctgtgtccatgtgatcacattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatactgccgcaataaacgtacatgtgcatgtgtctttatagcagcatgatttatagtcatttgggtatatacccagtaatgggatggctgggtcaaatggtatttctagttctagatccctgaggaatcgtcacactgacttccacaatggttgaattagtttacagtcccaccaacagtgtaaaagtgttcctatttctccacatcctctcccgcacccgttgtttcctgactttttaatgattgccattctaactggtgtgagatgatatctcatagtggttttgatttgcagttctctgatggccagtgatgatgagcattttttcatgtgttttttggctgcataaatgtcttcttttgagaagtgtctgttcatgtccctcacccactttttgatggggttgtttgtttttttcttgtaaatttgtttgagttcattgtagattctggatattagccctttgtcagatgagtaggttgcaaaaattttctcccatgttgtaggttgcctgttcactgtgatggtagtttcttttgctgtgcagaagctctttagtttaattagatcccatttgtcaattttgtctttggttgccattgcttttgatgttttggacatgaagtccttgcccacgcctatgtcctgaatggtaatgcctaggttttcttctagggttgttatggttttaggtctaacgtttaaatctttaatccatcttgaattgattttcgtataaggtgtaaggaagggatccagtttcagctttctacatatggctagccagttttcccagcaccatttattaaatagggaatcctttccccattgcttatttttctcaggtttgtcaaagatcagatagttgtaggtatgcggcattatttctgagggctctgttctgttccattgatctacatctctgttttggtaccagtactatgctgttttggttactgtagccttgtagtatagtttgaagtcaggtagtgtgatgccttcagctttgttcttttggcttaggattgacttggcaatgcgggctcttttttggttccatatgaactttaaagtagttttttttccagttctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagatttggggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagccttttgatgtgctgctggattcggtttgccagtattttattgagcatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaactccttcctggtttagtcttgggagagtgtatgtgtcaaggaatttatccatttcttctagattttctagtttattttcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattggttttttgaagggttttttgtgtctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttattgactttctgtctcgttgatctgtctaatgttgacagtggggtgttaaattctcccattattaatgtgtgggagtctaaatctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttctccaacttgccagtctgtgtcttttaattggagaatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgtttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttttctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgacaccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcgtcaaaaacattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgctcccagaggtggagcctacagaggcaggcaggcctccttgagctgtggtgggctccaccaagtttgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgacttggaaagggaactccctgaccccttgcgcttcccaggtgaggcaatgcctcggcctgcttcggctcgcgcatggtgagcgcacccactggcctgcgcccactgtctggcactccctagtgagatgaacccggtatctcagatggaaatgcagaaatcacccgtcttctgcgtcgctcacgctgggagctgtagaccggaagctgttcctattcggccatcttggctcctgaaaatcaggtttattttttaataatggctgtgctttacaacataagctcttgcaagccaatatgaacagactacagtatttcactgtggcaggctgaaagaatggccctccaaaaaaatattcacttcctagtccccagaatctatgaatactaccttaaatgcaaaagactgaatagtattttatttggtgaaagtgatatctaaaaatcctgagagtaaactcttaccctggattatgcgggtgggccctaaatctaataacaagtgaagtgtccttgtacgagcaaggcaatgggagattcgacacagacacacatggagtggagaaggcaatgtgaaaacagaggtagggattggagcaatgcagccacaaaccaaaaaaaca

SEQ ID NO: 12773 - DNA, 6069 bp, Homo sapiens
accattttgttttttttttttttctttttttttttttattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattcgggttggttccaagtctttgctattgtgaataatgccgcaataaacatacgtgtgcatatgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgtcttcttttgagaagtgtctgttcatgtccttcgccaactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaacttgaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttgactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaatttccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttgcctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatgagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgccacaatttcagctcctgttattggtctattaagagattcaacttcttcctggtttagtcttgggagagtgtatgtgtggaggaatttatccatttcgtctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttgggttggagagttctgtagatgtctattaggtctgcttggtgcagagctgagttcaattcctgggtatccttgttgactttctgtctcgttgatctgtctaatgttgacagtggggtgttaaagtctcccattattaatgcgtgggagtctaagtctcttcgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacctctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttcattggagcatttagtccatttacatttaaagttaatattgttatgtgtgcatttgatcctgtcattatgatgttagctggtgatattgctcgttagttgatgcagtttcttcctagtctcgatggtctttacattttggcatgattttgcagcggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgatgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtattttctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctgatttctttttattcgtttttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgtgttcctttggaggaggagagacgctctgcgttttagagtttccagtttttctgttctgttttttccccatcgttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtctgcccctgctggggggtgcctcccagttaggctgctcgggggtcaggggtcaggaacccacttgaggaggcagtctgccggttctcagatctccagctgcgtgctgggagagccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgcccgctgctttgtttacctaatcaagcctgggcaatggcgggcgcccctcccccagcctcgctgccgccttgcagtttgatctcagactgctgtgctagcaatcagcgagattccgtgggcataggaccctccaagccaggtgtgggatataatctcgtggtgcgccgttttttaagtcagtcagaaaagcgcagtattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccctccccacaccattttg

SEQ ID NO: 12774 - DNA, 5273 bp, Homo sapiens
ccacttttctttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtttatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcgtaaatgtcttcatttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtctaattagatcccatttgtcaattttgtcttttgttgccattgcttttggtgttttggacatgaagtccttgcccatgcctatgtcctgaatggtactgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggttcgtcaaagatcagatagttgtagatatgcggcgttatttctgagggctctgttctgttccattgatctatatctctgttttggtaccagtaccatgctgttttggttactgtaggcttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcctcgagcagtggtttgtagttctccttgaagaggtccttcacatcccttgtaaggtggattcctaggtattttattctctttgaagcaattgtgaatgggagttcactcgtgatttggctctctgtttgtctgttgttggtgtataagaatgcttgtgatttttgtacattgattttgtatcctgagactttgctgaaattgcttatcagcttaaggagattttgggctgagacaatggggttttctagatatacagtcatgtcgtctgcaaacagggacaatttgacttcctcttttcctaattgaataccctttatttccttctcctgcctaattgccctggccggaacttccaacactatgttgaataggagtggtgagagagggcatccctgtcttgtgccagttttcaaagggaatgcttccagtttttgcccattcagtatgatattggctgtgggtttgtcatagatagctcttattatgttgaaatacgtcccatcaatacctaatttattgagagtttttagcatgaagggttgttgaattttatcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttggtaaactattgattattgccacaattttcagctcctgttattggtctattcagagattcaacttcttcctggtttagtcttgggagagtgtatgtgtcgaggaatttatccatttcttctttatttttctagtttatttgtgtagaggtgtttgtagtatgctctgatggtagtttgtatttctgtgggatcagtggtaatatcccctttatcattttttattgcgtctatttgattcttctgtctttttttctttattagtcttgctagcggtctatcaattttgttgatcctttcagaaaaccagctcctggattcattaattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctgtaaatttccctctacacactgctttgaatgcatcccaaagattctggtatgttgtgtctttgttctcgttggtttcaaagaacatctttatttctgccttcatttcgttatgtatccagtagtcattcaggagcaggttgttcagtttccatgtagttgagtggttttgagtgagattcttaatcctgagttctagtttgattgcactgtggtctgagagatagtttgttatcatctctgttcttttacatttgctgaggagagctttacttccaagtatgtggtcaattttggaataggtgtggtgtggtgctgaaaaaaatgtatattctcttgatttgggctggagagttctgtagatgtctattaggactgcttggtgcagagctgagttcaattcctgggtatccttgctgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttctcgttgaattgatccctttaccattatgtaagggccttctttgtctcttttgatctttgttggtttaaagtctgttttatcagagactaggattgcaacccctgcctttttttgttttccattttcttggtagatcttcctccatccttttattttgagcctatgtgggtctctgcacgtgagatgggtttcctgaatacagcacactgatgggtcttgactctttatccaatttgccagtctgtgtcttttaattggagcatttagtccatttacatgtaaagttaatattgttatgtgtgaatttgatcctgtcattatgatgttagctggttattttgcttgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagaattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtagcctgacctttctctctggctgcccttaacattttttccttcatttcaactttggtgaatctgacaattatgtgtcttggagtgctcttctcgaggagtatctttgtggcattctctgtatttcctgaatctgaacgttggcctgccttgctagattggggaagtctcctgggataatatcctgcagagtgtttccaacttggtccattctccccatcactttcagtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattctccacgtagttctcgagccttggttttcagctccatcagctcctttaagcacttctctgtattggttattctagttatacattcttctaaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaagaggggaggcactctgcgttttagagtttccagtttttgtgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccg

SEQ ID NO: 12775 - DNA, 6069 bp, Homo sapiens
tttgtctttcttttttttttttttttttttttttattatactctaagttttagggtacatgtgcacattgtgcaggttagttacatatgtatacatgtgccatgctggtgtgctgcacccactaatgtgtcatctagcattaggtatatctcccaatgctatcccttccccctcccccgaccccaccacagtccccagagtgtgatattccccttcctgtgtccatgtgatctcattgttcaattcccacctatgagtgagaatatgcggtgtttggttttttgttcttgtgatagtttactgagaatgatggtttccaatttcatccatgtccctacaaaggatatgaactcatcatattttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagatggaatgttcttccatttgtttgtgttctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggtgttttctagataaacaatcatgtcatctgcaaacagggacaatttgacttcctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttgattgtgtctctgcccggctttggtatcagaatgatggtggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaattttcctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcccttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgatttttagagtttccagtttttctgtactgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgtccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcggatgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctggtagctgtagaccggagctgttcctattcggccatcttggctcctcctcccatttgtctttctttat

SEQ ID NO: 12776 - DNA, 10738 bp, Homo sapiens
tcccaaaatgctgggattacaggcgtgagccaccacgcccggcaaaagttattcttaacatgttaaaagttctaatgacaaacagataaaagctccatggtcttttttaaaaatataaaatggttttaaagactgggcttcaatttaaagatgtacatttgcttttcagattgaatttaataaacagcccacttctgcaacaagagggctacttttttgcctttatttttatttttaataattctatttatgaggtatgatatgatattttgatacatgtatataatgtgtgatgatcaaatcagggtaatagggttactttttcagtctggtcctcaggagacagaaaccacacagtaggttaaatagggaaaggtaatataaagaatttttaagcaatgatagaagagtaacaagcaagaacaaagttgggatgggagtttagaccttgttgaagaatatatagttgcagcccactggatggaggagaggtttgctggtttgcccaggctacagctgatccctattcactgggcaggcaggaataacctcctggggtactgacaaaacaggctgataagtaggcctggagagagtgtcagatgtgctactttaggcattcctggaaccaggagctcgagagaccacccttttcgggaatctagtgtacgtttgtatacgacttggaccaggatgtctaagagcagctatgtggaacaaaggcagggcagcaggccctgtaatgaccctggttggtgtgtactcaaaactggggaaagggtgtgggaaacagcaacctgggctggagaggcatttgctgggagtggagggggaaatagaggcaggatgttctgtcttgttctctatagctcaaaatactagaccacttgagggattccctcaagccatacaaaaacaggcagcaggctggatttagcctataggccacagttttccacactctgttctaggaacctggtgatggagagaccggagagaactagcgaggaaaaccccttcttcctgcagcatctctacaatgggctttactgacaagttttaacagcttgccagctaggaaatgtaaaatatttaaaaggcccagatctgttttcacgtatcaggcaacaaagggtgaatttgatgctgagagacaatacgttggaaactggcatagctggtgtggtagaaattatggtaggggaaggatggttgcttgagcaaagctttgattaatgagaagttgtgagaaaagagctgatatggcaacttttcttttctggatggaagatagaaaaggagtgtccttgttgggtttacctatgaggtatgagaatgatcattctgaacttttccctaggtgaggtgttcatgttctcttctgtaaaatgtgaataacactattcacctgccagtggtgttgaaagaagtagtgataatttaaacacaatgcctgatgaataggccttcagtaaatggtagctattcctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgttgggattacaggcgtgagccaccgcgcccggccagctattcttccctatatggatcaaaagctgagaaaaagccatagaagccggagctgggttaaaacagaaaatcagtgtgatttccctaggaaatggagaatttagtgtcttttgaatggaaatatttagaattggaattttgaaggaaaaatggaggaaattatgttattatgcagtgtaattatggaatgtattgtgaactgggaatgaaaataaggtttgctattggttatattctttagcatggacatgtattttcatggttacttaatttggtggagaacaaattttaattaatgaatttggattttgtgaactttcaggtttttagagattggatagaaataaggttctctgaggtggggatgtagtaccatacaacataaaattaggcatgtaggtctgagatgttttagttctcagactataacagcagttgcttatatatatggtaaatgattttctgtgtttctgctttggcttcatttgtgcagtattctgggattctgacaagggtggatgtctggggattactataacagaattgaatgatgcctagaatgtagtattattgtgaggctgcagcttgactgtgccttgggatgcctcaaacctcatattgaaagtatgaatcctcagagaaatgggttttcagtttgagattaactgatcatagtagaatggttcttagagacctcatattgtgggctcgtgcaaagacctaactattagtaatgcttggatgaggggcttaatttatgtagcacacttgtgtttgggtaagaaaaagaacttgggtaggaatttgataacactaaaagccaacacttctcccttgctgtcatttgggggttggggtacaggtatagattttatgtatgtttatgttatgtggggtatttagagatccttagtattcttcaatggaaagggccagggagaccagatcttcatattttcaggctacttgctgagagattttcctgctcctctagtgagatcccttgggtctaggctccccagactcacttccaaacaattgtgctgaggattaaaaggatgaatgcacaattgccaaactatccccatgcttttaagaaacattgttattttatttttgcattcctttttataagccacgttagtcttctccaaagctatgactgggactggtgggatcatttgttcaaatgactgttgttggggtcatttgtattaaagtagaagccacatagtagtgcagggggaagacagggtcttagaatataaaacaagatgagtcagaaaatgacttttggaaaaaaaagtagtagcaggttcaggtcaatgggggagtcttagtacactgctgaacaggtttctgtcattcatcttggggtgagataaattaaataaatgcaagataattgagtcagaaagatgcaggaccttggaatcccaggcctgtggatccagggagggacagtgagatagaatgaggttagatcagtatactgctgaattctgctgtgctctggcatggagttatccttggtgaaattaaatcagtataactccgtatgagtgagtgagattaatgaaacctctgtctgatgttcttgggatttagcatttaaaggttgctcactctttaaatcaaccaagttcctctagagacctccaagaacaaaaactatcttgctctggaattcaaagcagaaggatataggttagacatcattcccaagtgtccttcctccctacaaccctctcacccctgacccacaaaacttcatgaaattaagagctattgctctttctcacaaaaggttggtgctgtcctctttaagtgataacttctgatttataatcatagaccattaaaattcaaagagatacttcaggcttgtctttgtggagctggagttggtatctctggtttagtggtgtggtgctagtttttactgacttttttcctaaagaaatcacttttctgaagtatcttttccttttgggatgtcagaagaagagagctggcagtagatttcttccaaagaggaaggaaagaactcttaagggattggtgatttggaaaatatctgtcagctagctttcttgacctctgagccagctgagtggcaagtggggcatttgtttcctgctcttattaaaaaaaagtattcatctactacttacagcatatttatacagagatctataaaaaaatgaatggttatatagataaatgaaaatgtttgcttttttgctgttgatgtttttgattttttttctttttctttcttttattttatactttaagtttaggatacatgtgcacaatgtgcaggttagttacatatgtatacatgtgaaatgctggtgcgctgcacccactaactcgtcatctagcattaggtatatctcccaatgctatccctcccccctccccccaccccaccacagtccccagagcgtgatattccccttcctgtgtccatgtgatctcattgttcaattcccacctatgagtgagaatatgtggtgtttggttttttgttcttgtgatagtttactgagaatgatgatttccaatttcatccatgagactaaaattcctaagacagtaatcccagctacttgggaggctgaggcaggggaatcgtttgaagctgggaggcggaggttgcagtgaatcgagaccgtgccacagcactccagcctgggcgaccaaaagaggctgtcttaaaagaaaaaaaaaatcctaagagagtaaatgatctgacattgaccatgtgcccatttctggaccagtcactgtgccaggaagaatgagtgaataatgacaggggttgggggtggggaggtgagggtggagaggatttggggattccatgattaacagtgtctcttggaagcatattgaaccatggagttcagttattagaggaatggtagagataagctgagcagacaataacaattgtctccccccaccccacaacagtccccagagagtgatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttatagtcctttgggtatatacccagtaatgggatggctgggtcaaatggtatttctagttctagatccctgaggaatcgccacactgtcttccacaatggatgaattagtttacagtcccaccaacagtgcaaaagtgttcctatttctccacatcctctccagcacctgttgtttcctgactttttaatgattgccattctaactggtgtgagatgatatctcattgtggttttgatttgcatttctctgatggccagtgatagtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggcttttgttgctattgcttttggtgttttagacatgaagtccttgcccatgcctatgtcctgaatggtaatgcctaggttttcttctagggtttttatggttttaggtctaatgtttaagtctttaatccatcttgaattgatttttgtataaggcataaggaagggatccagtttcagctttctacatatggctagccagttttcccagcaccatttattaaatagggaatcctttccccattgcttgtttttctcaggtttgtcaaagatcagatagttgtagataagaggcgttatttctgagggctctgttctgttccattgatctatatctctgttttggtaccagtaccatgctgttttggtgactgtagccttgtagtatagtttgaagtcaggtagtgtgatgcctccagctttgttcgtttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctagccatgagcatggaatattcttccatttgtttgtatcctcttttatttcatagagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttaccagcttaaggagattttgggctgagacaatggggttttctagatatacaaacatgtcgtctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtctttgcccattcagtatgatattggctgtgggtttgtcatagatagctcttattattttgagatatgtcccatcaatacctaatttattcagagtttttagcatgaagggttggtgaattttgtcaaaggccttttctgcatctattgagataatcatgtggtttttgtctttggttctgtttatgtgctggattacatttattgatttgcgtatattgaactagccttgcatcccagggatgaagcccacttgatcatggtggataagctttttgatgtgctgctggattctgtttgccagtattttattgaggatttttgcatcaatgttcatcaaggatattggtctaaaattgtctttttcggttgtgtctctgcccggctttggtatcaggatgatgctggcctcataaaatgagttagggaggattccctctttttctgttgattggaatagtttcagaaggaatggtaccagttactccttatacctctggtagaattcggctgtgaatccatctggtcctggactctttttggttggtaagctattgataattgccaaatttcagctcctgttattggtctattcagagattcaacttcttcctggtttagtcttgggagggtgtatttgtcgaggaatttatccatttcttctagattttctagtttatttgcgtagaggtgtttgtagtattctctgatggtagtttgtgtttctgtgggatcagtggtgatatcccctttatcattttttattgcatctacttgattcttctctctttttttctttattagtcttgctagcggtctatcaattttgttgatcctttcaaaaaaccagctcttggattcattaattttttgaaggggttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcgttatgtacccagtagtcattcaggagcaggttgttcagtttccatgtagttgagcagtttttgagtgagtttcttaatcctgagttctactttgattgcactgtggtctgagagatagtttgttataatttctgttcttttacatttgctgaggagagctttacttccaactatgtggtcaattttggaataggtgtggtgtggtgctgaaaaaaatgtatattgtgttgatttggggtggagagttctgtagatgtctattaggtccgcttgatgcagagctgagttcaattcctgagtatccttgttaactttctgtgtcgttgatctgtctaatgttgacagtggggtgttaaagtgtcccattattaatgtgtgggagtctaagtctctttgtaggtcactcaggacttgctttatgaatctgggtgctcctgtattgggtgcatatatatttagaatagttagctcttctcgttgaattgatccctttaccattatgtaatggccttctttgtgtcttttgatttttgttggtttaaagtctgttttatcagagactaggattgcaacccctgcctttttttgttttccatttgcttggtagatcttcctccacccttttattttgaacctatgtgtgtctctgcatgtgagatgggtttcctgaatacaacacactgatgggtcttgactctttctccaatttgccagtctgtgtcttttaattggagcatttactccatttacatttaaagttaatattgttatgtgtgaatttgaacctgtcattatgatgttagctggttattttgctcgttagttgatgcagtttcttcctagtctcgatggtctttacattttggcatgattttgcagcggctggtactggttgttcctttccatgtttagtgcttccttcaggagctcttttagggcaggcctggtggtgacaaaatctctcaacatttgcttgtctgtaaagtattttatttctccttcacttatgaagcttagtttggctggatatgaaattctaggttgaaaatttttttctttaagaatgttgaatattggcccccactctcttctggcttgtagagtttctgctgagagatcagatgttagtctgatgggcttccctttgtgggtaacccgacctttctctctggctgcccttaacattttttccttcatttcaactttggtgaatctgacaattatgtgtcttggagttgctcttctcgaggagtatctttatggcgttctctgtatttcctgaatctgaatgttggcctgccttgctagattggggaagttctcctggataatatcctgcagagtgttttccaacttggttccattcccccatcactttcaggtacaccaatcagaagtagatttggtcttttcacatagtcccatatttcttggaggctttgttcgtttctttttattcttttttctctaaacttcccttctcgcttcatttcattcatttcatcttccatcgctgataccctttcttccaattgatcgcatcggctcctgagtcttctgcattcttcccgtagttctccagccttggccctcagctccatcagctcctttaggcacttctctctattgggtattctagttatacattcatctaaatttttttcaaagcttttaacttctttgcctttggtttgaatttcctcctgtagctcatagttcgatcgtctgcagccttctctcaactcgtcaaagtcattctccgtccagctttgttccattgctggtgaggaactgcgttcctttggaggaggagaggttctctgctttttagagtttccagtttttctgctctgttttttccccatctttgtggttttatctacttttggtctttgatgatggtgatgtacagatgcgtttttggtgtggatatcctttctgtttgttagttttccttctaacggacaggaccctcagctgcaggtctgttggagtttgctaaaggtccactccagaccctgtttgcctgggtatcagcagcggcgtctgcagaacagtggtttttcgtgaacggtgaatgctgctgtctgattgttcctctggaagttttgtctcagaggagtacccggccgtgtgaggtgtcagtttgcccctacttgggggtgcctcccagttaggctgctcaggggtcaggggtcagggaagcacttgaggaggctgtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcagacaggcaggcctccttgagctgtggtgggctccacccagttcgagcttcccggctgcattgtttacctatgcaagcctgggcaatggggggtgcccctcccccagccttgctgccgccttgcagtttgatctcagactgctgtgctagcaatcggcgagactccgtggacgtaggaccctctgagccaggtgtaggatataatctcctggtgtgccggtttttaaccctgtcagaaaagcacagtattcgggtgggagtgacctgattttctaggtgccgtctgtctcccctttctttgactaggaaagggaactccctgaccccttgcgcttccggagtgaggcaatgcctcgccctgcttcggcttgcccacggtgcgctgcacccactgacctgtgcccactgtctggcactccctagtgagatgaacccggtacctcaggtggaaatgcagaaatcacccatcttctgcgtcgctcacgctgggagcttagactggagctg

SEQ ID NO: 12777 - DNA, 4827 bp, Homo sapiens
ttcttttttctttttattatactttaagttctagggtacatgtgcacaacgtgcaggtttgttacatatttatacatgtgccatgttggtatgctgcaccaattaactcgtcatttacattagatatatctcctaatgctatccctcccccctcccccaaccccacaacaggccccggtatgtgatgttccccatcctgtgtccaagggttctcattgttcaattcccacctatgagtgagaacatgtggtgtttggttttccgtccttgcgatagtttgctgagaatgatggtttccagcttcatccatgtccctacaaaggacatgaactcatctttttatggctgcagagtattccatggtgtatatgtgccacattttcttaatccagtcagtcattgatggacatttgggttggttccaagtttttgctattgtgaatagtgccgcaatgaacatacgtgtgcatgtgtctttatagcagcatgatttatattcctttgggtatatacccagtaaagggatggctgggtcaaatggtatttctagttctagatccctgaggaatcgccacactgacttccataatggttgaactagtttacagtcccaccaacagtgtaaaagtgttcctatttctccacatcctctccagcacctgttgtttcctgactttttaatgattgccattctaactggtgtgagacggtatctcattgtggttttgatttgcatttctctgatggccagtgatgatgagcattttttcatgtgtctgttggctgcataaatgtcttcttttgagaagtgtctgttcatatccttcgcccacttgttgatgtggttgtttttttttttcttgtaaatttgtttgagttctttgtagattctggatattagccctttgtcagaagagtagattgcaaaaattttctcccattctgtaggttgcctgttcactctgatggtagttacttttgctgtgcagaagctctttagtttaattagatcccatttgtcaattttggcttttgttgccattgcttttggtgttttagacatgaagtccttgcccatgcctatgttctgaatggtattgcctaggttttcttctagggtttttatggttttaggtctgacatttaagtctttaatccatcttgaattaatttttgtataaggtgtaaggaagggatccagtttcagctttctacatatgggtagccagttttcccagcaccatttattaaatagggaatccttttcccatttcttgtttttgtcaggtttgtcaaagatcagatggttgtagatgtgtggtattatttctgagggctctattctgttccattggtctatatctctgttttggtaccagtaccatgctgttttggttactgtagccttgtagtatagtttgaagtcaggtagcgtgatgcctccagctttattctttaggcttaggattgacttgtcaatgcgggctcttttttgcttccgtatgaactttaaagtagttttttccaattctgtgaagaaagtcactggtagcttgatggtgatggcattgtatctatacattaccttgggcagtatggccattttcacaatattgattcttcctgtccatgagcatggaatgttcttccatttgtttgtatcctcttttatttcattgagcagtggtttgtagttctccttgaagagttccttcacatcccttgtaagttggattcctaggtattttattctctttgaagcaattgtgaatgggggttcactcatgatttggctctctgtttgtctgtcattggtttataagaatgcttgtcattttttcgcattgattttgtatcctgagattttgctgaagttgcttatcagcctaaggagattttggactgagacgacggggttttctagatatataatcatgtcatctgcaaagagggacaatttgacttcctgttttcctgattgaataccctgtatttctttctcttgcctaattgccctggccagaacttccaacactatgttgaataggagtggtgagagagggcatccctgtcttgtgccagttttcaaagggaatgcttccagttttcacccattcagtatgatactggctgtgggtttgtcatagatagctcctattattttgagatacatcccatcaatacctaatttattgagagtttttagtgtgaagggctgtagaattttgttgaaggccttttctgcatctattgagataatcatgtgtttttttcctttggttctgtttatatgctggattatgtttattgatttgtgtagtctgaaccagccttgcatcccagggatgaagcccacttgatcatggtggataagctttttgatgtgttgctggattaggtgtgccagtattttattgaggatttttgcatcaatgttcatcagtgatattggtttaaaattctgtttttttgttgtgtctctgccaggccttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattaattattgcctcaatttcagagcctgttattggtctattcagaaattcaacttcttcgtggtttagtcttgagaaggtgcatgtgtccaagaatttatctctttcttctagattttctagtttatttgtgtagaggtgtttatagtattctctgatggtagtttgtgtttctgtggcatcggtggtgatatccccttgatcattttttattgcatctatttgattcttctctcttttattctttattagttttgctagcagtctatcagttttgttcatcttttcaaaaaaccggctcctggattcattgatttttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcttgctttgccttgtgggcatttagtgctataaatttccctctatacactgctttaaatgtgtctcagagattctggtatgttgtgtctttgttctccttggtttccaagaacatctttatttctgccttcatttctgtatgtacccagtagtcattcaggagcaggttgttcagtttccatgtagttgagcagttttgagtgggtttcttaatcctgagttctaatttgattgcactgtggtctgagagacagtttgttataatttctgttcttttacattactgaggagtgctttacttccaactatgtggtcagttttggaataagtgtgatgttgtgctgagaagaatgtatattctgttgatttggggtggagacttctgtaactatctattaggtccacttggtgcagagctgagttcaattcctggatatccttgttaactttctgtctcgttgatctgtctaatgttgacagtggggtgttaaagtctcccattattattgtgtgggagtctacgtctctttgtaggtctgtaaggacttgctttatgaatctgggtgctcctgtattgggtgcatatatagttaggatagttagctcttcttgttgaattgatccctttaccattatgtaatggccttctttgtctcttttgatctttgttagtttaaagtctgttttatcagagactaggattgaaacccctgcctacttttgttttccatttgcttagtatatcttcttccatccctttattttgagcctatatgtgtctctgcatgtgagatgggtctcctgaatacagcacactgatgggtcttgactctttatccaatttgccagtctgtgtcttttaattggagcatctaggtcatttaaatttaagtttaatattgttatgtgtgaatttgatcctgtcattatgatgttagctggttattttgctcgttagttgatgcagtttcttcctagcctcaatggtctttacaatttggcatgtttttgcagtggctggtaccagtcattccttcccatgtttagtgcttccttcaggagctcttttaggacaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacctgacctttctctctgtctgcccttagcattttttccctcatttcaactttggtgaatcttacaattatgtgtcttggagttgttcttcccgaggagtatctttgtggtgttctctgtatttcctgaatttgaattttggcctgcctttctgggttggggaagttctcctggataatatcctgcagagtgtttttcaacttggttcctctccccgtcactttcaggtacaccaatcagacgtacatttggtcttttcacctagtcccatatttcttggaggctttgattgtttttactcttttttctctaaacttctcttctcacttcatttcattcatttgatcttcaatcactgataccctctattctagttgatgaaatcagctactgaagcttgtgcatttgccgcatagttctc

SEQ ID NO: 12778 - DNA, 5018 bp, Homo sapiens
ttttttttattatactttaagttctagggtacatgtgcacaatgtgcagctttgttacatatgtacacacgtgccatgttggtgtgctgcacccattaacttgtcatttacattaggtatatcccctaatgctatccctccacactccctccaccccacagcaggccccagtgtgtgatgttcctcaccctgtgtccaagtgatctcattgttcaattcccacctatgagtgagaacatgcggtgtttgcttttctgtccttgtgatagtttgctcaaaatgatggttttcagcttcatccatgtccctgcaaaggacatgaactcatccttttctatggctgcatggtattccatggtatatatgtgccatgtttttttactccagtctatcgttgatggacatttgggttggttccaaatctttgctgttgtgaatagtgccaaaataaacatacgtgtgcatgtgtctttatagtagcgtgatttataatcctttgggtgtatacccagtaataggatggctgggttaaatggtatttctagttgtagatccttgtggaatcaccacgccgtcttccacatggttgaactagattacggtcccaccaacagtgtaaaagtgttcctatttctccacatcctctccagcacctgttgtttcctgactttttaatgattgtcattctaactggtgtgacatggtatctcactgtagttttgatttgcatttctctgatggccagtgatgatgaccattttttcatgtgtctgttggctgcatagatgtcttctttgagaagtgtctgttcatatccttcgcccactttttgatggggttgtttgatttttttcttgtaactttgtttaagttctttgtatatactggacattagccctttgtcagatgggtaaattgtaaacattttctccccttctgtaggttgcctgttcactctgatggtactttcttttgctgtgcagaagctctttagtttaattaaatcccatttgtctattttggcttttgttgccattgcttttggtgttttagtcatgaagtctttgcccatgcctatgtcctgaatggtattgcctaggttttcttctagggtttttatggttttaggtctaacatttaagactttaatccatttcaattaatttttttataaggtgtaaggaagggatccagtttcagctttctacatagggctagccagttttcccagcaccatttatcaaatagggaatcctttccccatttcttgtttttgtcaggtttgtcaaagatcagatggttgtagatgtgtggtattatttccgagggctctgttttgttccattggtctatatctctgttttggtaccagtaccatgctgttttgcttactgtagccttgtagtatagtttgaaatcgggtagtgtgatgcctccagctttgttcttttggcttaggattctcttggcaatgcgggctctttttggttccatatgaactttaaagtagttttttttccaattctgtgaagaaagtcattggtagcttgatggggatggcattgaatctataaattaccttgggcagtagggccattttcacgatattgattcttcctatccatgaacatggaatgctcttccatttgtttgtgtcctcttttacttcattgagcagaggtttgtagttctccttgaagaggtccttcacatcccttgtaagttggattcctaggtattttattctctttgaagcaattgtgaatgggagttcactcatgatttggctttctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgatttcctcttttcctaactgaataccctttatttccttctcttgcctaattgccctggccagaacttccaacactatgttgaataggagtggtgagagagggcatcccgtcttgtgccacttttcaaagggaatgcttccagtttttgcccattcagtatgatgttggctgtgggtttgtcataaatagctcttattattttgaaatacatcccatcaacacctagtttatttagagttttaagcatgaagggctgttgaatttgtccaaggccttttctgaatctattgagaaaatcatgtggtttttgtctttggttctgtttacatgatggattacgtttattgatttgcatgtgttgaaccagccttgcatcccagggatgaagccaacttgatcgtggtggatacactttttgatgggcagctggatttggtttgccagtatcttattgaggatttttgcactgatgttcatcagggatatttgtctaaaattctctttttttgctgttgtgtctctgcccggctttggtatcaggatgatgctggcctcatgaaatgagttagggaggattcactgtttttctattgattggaatagtttcagaaagaatggtaccagctcctgcttttacctctggtagaattcagctgtgaatctgtctggtcctggactttttttttttggttgggaggctattaattattgcctcaatttcagagcctgctattggtctatcaagagattcaacttcttcctggtttagtcttggagggtgtgtatgtccaggaatttatccatttcttctagattttctagtttatttggtagaggtgtttatactattctctgatggtagtttgtatttctgtgggatcggcggtgatatgccctatatcgttttttattgcatctatttgattcttctctcttttcttctttattcgtcttggtagtggtctatcaattttgttgatcttttccaaaaaccagctccttgattcattgattttttgaagggtttttttgtgtctctatctccttcagctctgctctgatcttagttatttcttgccttctgctagcttttgaatgtgtttgctcttgcttctctagttcttttaattgtgatgttaggatgtcaattttagatctttcctgctttttcttatgggcatttagtggtataaatttccctctacacacttctttaaatgtgtcccagagattctggtatgttgtgtctttcttctcattggtttcaaagaacatctttatttctgccttcattatgttatgtacccagtagtcattcaggagacagttattcagtttccatgtagttgagtggttttgagtgagtttcttaatcctgagttctagtttgattgcactgtggtctgagagacagtttgtcataatttctgttcttttacatttgctgaggagtgctttacttccaactatgtggtccattttggaataagtgcgatgtggtgctgagaagaatgtatattctgttgatttggggtggagagctctgatgtctattaggtcctcttcatgcagagctgagttcaattactggatatctttattaactttctgtctcattgatctgtctaacgttgacagtggggtgttaaagtctcccattagtattgtgtgggagtctaagtctctttgtaggtctctaaggacttgctttatgaatctgggtgctcctgtattgggtgcatatatatttaggatagttagctcttgttgttgaattgatccctttatcattatgtaatggccttctttgtctctttcggtctttgtttgtttaaagtctgttttatcagagatgaggattgcaacccccgctttttttgtttgttttccatttgcttggtagatcttcctccatccctttatcttgagactatgtgtgtctctgctcatgagatgggtctcttgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctagttagttgatgcagtttcttcctagcatagatggtctttacaatttggcatgcttttgcagtggctgatactggctgatcctttctatgtttagtgcttccttcaggagttcttgtaaggcaggcctggtggtgacaaaatctctcagcattcgcttgtctgtaaagtattttatttatccttcacttatgaagcttagtttggctggatatgaaattctgggttgaaaattcttttaagaatgttgaatattggcccccactctcttctggcttgtagagtttctgccaagagatctgctattagtctgatgggcttccctttgtgggtaacctgacctttctctctggctgcccttaacattttttccttcatttcaactttggtgaatctgacaattatgtgtcttggagttgcttttctcgaggagtatctttgtggcattctgtgtatttcctgaatttgaatgttggcctgccttgctaggttggggaagttctcctggataatatcctgaagagtgttttccaacttggttccattctccccatcactttcaggtacaccagtcagacagagatttggtcttttcacatggtcccatatttcttggaggctttgttcatttctttttactcttttttctctaaacttctcttctcacttcatttcattcatttgatcttcaatcactgttaccctttcttccacttgatcaaattggctactgaagcttgtgcatgcatcacgtagttctcgtgccatgctttccagctccatcaggttatttaaggtcttctctatgctgtttattctagttagccattcgtctaatcttttttcaaggtttttagcttctttgtgatgggttcgaacatcctcctttagcttggagaagtttgttactactgattgtctgaagccttcttctctcaacttgtcaaagtca

SEQ ID NO: 12779 - DNA, 7029 bp, Homo sapiens
tatgtatacatgtgccatgttggtgtgctgcacttgttaactcgtcatttacattgggtatatctcctaatgctatccctccaccttcagcccaccctacgacaggccccggtgtgtgatgttccccaccctgtgtccaagtgttctcattgttcaattcccacctataaatgagaatatgcagtgtttggttttctgtccttgcgatagtttgctcagaatgatggtttccagcttcatccatgtccctacaaaggacatgaactgatccttttttatggctgcatagtattccatggtgtatatgtgccacattttcttaattaggtctatcattgatggacatttgggttggttccaagtctttgctattgtgaatagtgctgcaataaacatacatgtgcatgtgtctttatagcagcatgatttataatcctttgggtatatgtccagtaatgggatggctgggtcaaatggtatttctagttctagatccttgaggaatcgccacactgtcttccacaatggttgaactagtttacagtcccaccaacagtgtaaaagtgctcctatttctccacagcctctacagcatctgttgtttcctgactttttaatgttcaccattctaactgctgtgagatggtatctcattgtggttttgatttgcatttctctgatggccagtgatgatgagcattttttcatgtgtctattggctgcataaatgtcttcttttgagaagtgtctgttcatatactttgcccactttttgatggggttgtttgattttttcttgtaaatttgtttaagttctttgtagattctggatattagccctttgtcagatgagtaggttgcaaaaattttctcccattctgtaggttgcctgttcactctgatggtagtttcttttgctatgcagaagttctttggtataattagatcccatctgtcaattttggcttttgttgccattgcttttggggttttggtcatgaagtccttgcccatgcctatgtcctgaatggtattgcctaggttttcttctacagtttttatggttttaggtctaacatttaagtctttaatccatcttgaattaatttttgtataaggtgtaaggaagggatccagttgcagctttctacatatggccagccagtttccccagcaccatttattaaataggcaatccttttcccatttcttgtttttgtcaggtttgtcaaagatcaggtggctgtagctgtgtggtgttatttctgaggtctctgttctgttccattggcctatatctctgttttggtaccagtaccatgctgttttgcttactatagccttgtagtatagtttgaagtctggtagcgtgatgcctccagctttgttctttggcttaggattgtggcaatgcaggctcttttttggttccatatgaactttaaagtagttttttccaattctttgaagaaagtcattggtaacttgataaggatggcattgaatctataaattacctttggcagtatggccattttcatgatattaattcttcctatccatgagcatggaatgttcttccatttgtttgtgtcctcttttatttcattgagcagtggtttgtagttctccttgaagaggtccttcacatcccttgtaagttggattcctaggtattttattttctttgaagcaattgtgaatgggagttcgctcatgatttggctctcttgtttgtctgttattgatgtataggaatgcttgttatttttgcacattgattttgtatcctgagactttgctgaagttgcttatcagcttaaggagattttgggctgagacgatggggttttctaaatatcatgtcatctgcaaatagggacaatttgacttcctcttttcctaattgaataccctttatttctttctcctgcctgattgccctggccagaacttctaacaccatgttgaataggagtggtgagggagggcatccctgtcttgtgccagttttgttttcaaagggaatgcttccagtttttgcccactcagtatgatattggctgtcagtttgtcataaatagctcttattattttgagatacgtcccatcaatacctagtttattgaaagtttttagcatgaagggctgttgaattttgtcaaaggccttttctgcatctgttgagataatcgtgtggtttttgtctttggttctgtttatatgatggattaaatttatggatttgcatatgttgaaccagccttgcaacccagggatgaagccaactggatcatggtggataagctttctgatgtgctgctggattcgatttgccagtattttattgaggatttttgcatcgatgttcatcagcgatattggtctaaaattctctttttttgttatgtctctgcccggctttggtatcaggatgatgttggcctcacaaaatgaattagggaggattccctctttttctattgattggaatagtttcagaagaaatggtgccagctcctctttgtacctctggtagaattcggctgtgaatccatctggtcctggactttttttggttggtaggctattaattattgcctcaatttcacaacctgttattggtctaatcagggattcaacttcatcctggtttagtcttaggaggttgtatgtgtccaggaatttatccatttcttctacattttctagtttatttgcgtagaggtgtttatagtattctctgatggtagtttgtatttctgtgggatcagtggtgatatcgcctttatcattttttattgcatctatttgattcttctctcttttcttctttattagtcttgctagcagtctatcaattttgttgatctctcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgtttgggtgtcagttttagatctttcctgctttctcttgtgggtatttagtgctataaatttccctctacacactgctttgaatgtgtcccagagattctggtatgttgtgtctttgttctcattggtttcaaagaacatctttatttctgccttcagaaataaatgactactgtacccagtagtcattcaggagcgggttgttcagtttccatgtagttgagcagttttgagtgagtttcttaatcctgagttctagtttgattgcactgtggtctgagagacagtttgttttaatttctgttctttaaaatttgctgaggagtgctttacttccaactatgtggtcagttttggaatacatgtgatgtggtgctgagaagaatgtgtagtctgtagatttgggatggagagttctgtagatgtctattaggtccacttggtgcagagctgagttcaattcctggatatccttgttaacgttctgtctcgttgatctgtctaatgttgacagtggggtgttaaagtctcccattattgttgtgtgggagtgtaagtctctttgtaggtctctaaggacttgctttatgaatctgggtgctcccgtattgggtgcgtatatatttaggatagttagctcttcttgttgaattgatccctttaccattatgtaatggccttctttgtgtcttttgatctttgttggtttaaagtctgttatatcagagactaggattgcaacccttgcttttttctgttttccatttgcttggtagatcttccaccatccctttattttgagcctatgtgtgtctctgcacatgagatgggtctcctgaatacagcacactgatgggtcttgactccttatcccatttgccagtctgtgtcttttaattggagcatttagcccatttacattaaggttaatattgttatgtgtgaatttgatcctgtcattatgatgttagctggttattttgctcattagttgatgcagtttcttcctagcatcaatggtctttacaatttggcatgtttttgcagtggcttttaccagttgttcctttccatgttcactgcttccttcaggagctcttgtaaggcaggcctggtggtgacaagatttctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtcttatgggcttccctttgggggtaacctgacctttctctctggccgcccttaacattttttccttcatttcaactttggtgaatctgacaattatgtgtcttggagttgctcttcttgaggagtatctttgtggtgttctctgtattttgtgaatttgaatgttggcctcccttgctaggttgaggaagttctcctggataatatcctgaagagtattttccatcttggttccattctccccatcactttcaggtacagcaatcagacatagatttggtcttttcacatagtcccatatttctcagaggctttgtttgtttctttttactcttttttctctaaacttatcttctcacttcatttcatttatttgatcttcaatcactgatgccctttcttctacttgatgaaatcagcttctgaagcttgtgcatgcgtcaggtagttcttgtgccatggttttcagctccatcaggtcatttaaggacttctctacactgtttattctagttagccattcgtccaatcttttttcaaggtttttagcttctttgcaatgggttcaaatatcctcctttagctcagagaagtttgttattaccaatcttctgaagccttcttctctcaactcatcagagtcaatctccgtccagctttgttccgttcctggtgagcggctgcattcctttggaggggaagaggggctgtgatgtttagaattttcagcttttctgctctggtttctccccatctttgtggttttatatacctttggtctttgatgatggtgacgtacagatggggttttggtgtggatgtgctttctgtttgttagttttccttctaacagtcaggaccctcagctgcaggtctgttggaatttgctgctggtccactccagaccctgtttgcctgggtatcaccagtggaggctgcaggactgcaaatattgcagaacagcagatgttgctgtctgatccttcctctggaagcttcgtctcagaggggcactggactgtatgaggtgtcagtcagcccctactgggaggtgtctcctagttaggctactcgggggccagggacccacttgaggaggcagtctgtcagttctcagatctcagacttggtgctgggagaaccactactctcttcaaagctgttagacagggacgtttaagtctgcagaagtttcttctgccttttgttcagctatgtcctgcccccagaggtggagtctactgaggcaggcaggcctccttgagctgcggtgggctccacccagttggagcttcctggcctctttgtttacctactcaggcctcagcaatagcggacacccctcccccagcctcgctgctgccttgcaatttgatctcagactgctgtgctagcagtgattgaggctctgtgggcgagtgacccttacagccaggtgtgggatataatctcctgctgtgccatttgctaagaccgttggaaaagtgcagtattagggtgggagtgtcccgattttccagatacagtctgtcatgacttcccttaggtaggaaagggaattcctggacccttgggcttcccgggtgaggcagtgccccaccctgctttgtgggctgcactcactgtctgacaagccccagtgagatgaacctggtacctcagttggaaatgcagaaatcacctgtcttcggcgttggtcacgctaggagctgcagactggagctgttcctatttggctgtcttggaacctctctagatcatgtatttttatgcattctggcaatctgtgtcttttgattagagagtttactccatttacatttaaagtaattactgataaggaggaatttaaatctgtcattttgctgcatgttttttatatgccatgcatcttatttaccttttgtttcctacattattgtcttcttttgtgtttaatttttatagtgaaatatttaaattcctttgtcattttcttttgtgtacattctacagatattttctttaaggttgccatggggattacatttggtatttaaagttgtaacactctaggctgggcgcagtggttcacgcctgtaatcctagcactttcggaggccgaggtgggtggattgcaaggtcaggagattgagaccatcctggctaacatggtgaaaccccgtctctactaaaaataccaaaacaaaattagccgggcgtggtggtgggcacctgtagtcccagctactcaggatgctgaggcgagagaatggcgtgaacctgggaggcggagcttgcagtgagccgagatcatgccactgtactccagcttgggcaacagagcgagactccatctcaaaaaacaaacaaaaaaacaaaacaaaaagttataacactctaatttgaatttataccatcttaacttcagtaacacacaaaatctttgctcctttatagctctgccctcacctcttttgattgttattttcacaagattacattattatacattgtgagtccaaaaatgtaaatgaatactttctttaaatgtattcatttacattttgtatttaaatgaatttatgtatttaaatgaatttatgtatttaaatgaatatatgtatttaaatgaatatatgtatttaaatgaatatttctttaaatgtaaattttcatttgaactttggtgaatctgacaattatgtgtcttggagttgctcttctcaagg

SEQ ID NO: 12780 - DNA, 6060 bp, Homo sapiens
agatgtctttatttcatcctttttttttagggtttttttttattatacttgaagttttacggtacatatgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcagagtattccatggtgtatatgtgccacattttcttaatccagtctatcattgttggacatttgggttggttccaagtctttgctattgtgaataatgccgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtgtctcattgtggttttgatttgcatttctctgatggccagtgatgatgagcattttttcatgtgttttttggctgcataaatgtcttcttttgagaagtgtctgttcatgtccttcgcccactttttgatgggtttgtttgtttttttcttgtaaatgtgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcgattttgtctttgattgtcattgcttttggtgttttggacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatgtggctagccagttttcccagcaccatttattaaatagggaatcctttccccattgcttgtttttctcaggtttgtcaaagatcagatagttgtagatatgcggcattatttctgagggctctgttctgttccattgatctatatgtctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgaatgggagttcactcatgatttggctctctgtttgtctgttgttggtgtataagaatgcttgtgatttttgtacattgattttgtatcctgagactttgctgaagttgcttatcagcttaaggagattttgggctgagaaaatgcggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacatcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctatgcagagattcaacttcttcctggtttagtcttgggagattgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtccatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattttgatgttagtgtgtcaattttggatctttcctgctttctcttgtgggcatttagtgctataaatttccctctacacactgctttgaatgcgtcccagagattctggtatgttgtgtctttgttctcgttggtttcaaagaacatctttatttcttccttcatttcgttatgtatccagtagtcattcaggaacaggttgttcagtttccatgtagttgagcagttttgagtgagattcttagttctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttagggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccgttatgtaatggccttctttgtctcttttgatctttgttggtttaaagtctgttttatcagagactaggattgcaacctctgcctttttttgttttccatttgcttggtagatcttcctccatccttttattttgagcctatgtgtgtctctgctcatgagatgggtttcctgaatacagcacactgatgggtcttgactctttatccaatttgccagtctgtgtcttttaattggagcatttagtccatttacatttaaagttaatatggttatgtgtgaatctgatcctgtcattatgatgttagctggttattttgctcgttagttgatgcagtttcttcctagtctcgatggtctttacattttggcatgattttgcagcagctggtaccggttgttcctttccatgtttagcgcttccttcaggagctcttttagggcaggcttggtggtgacaaaatctctcagcatttgcttgtctgtaaaggattttatttctccttcacttatgaagcttagtttggctggatatgaaattctgggttgaaaattcttttctttaagaatgttgaatattggccaccactctcttctggcttgtagggtttctgctgagagatccgctgttagtctgatgggcttccctttgagggtaacctgacctttctctctggctgcccttaacattttttccttcatttcaactttggtgaatctgacaattatgtgtcttggagttgctcctctcgaggagtatctttgtggcgttctctgtatttcctgaatctgaacgttggcctgccttgctagattggggaagttctcctggataatatcctgcagaatgttttccaacttggttccattctccccatcactttcaggtacaccaatcagacgtagatttggtcttttcacatagtcccatatttcttggaggctttgctcattttttttttattcttttttctctaaacttcccttctcgcttcatttcattcatttcatcttccattgctaataccctttcttccagttgatcacatcggctcctgaggcttctgcattcttcacgtagctctcgagccttggttttcagctccatcagctcctttaagcacttctctgtattggttattctagttatacattcttctaaatttttttcaaagttttcaacttctttgcctttggtttgaatggcctcccgtagctcagagtaatttgatcgtctaaagccttcttctctcagcttgtcaaagtcattctccatccagctttgttccgttgctggtgaggaactgcgttcctttggaggaggagaagcgctctgtgttttggagtttcccgtttttctgttctctttttcccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtttgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccccgcccccagaggtggagcctacagaggcaggcaggcctccttgagctgtggtgggctccacccagtttgagcttcccagctgctttgtttacctaagcaagcctgggcaatggtgggcgcccctcccccagccttgctgctgccttgcagtttgatctcagactgctgtgctagcaatcagcgagactccgtgggcgtaggacctccgagccaggtgcgggatgtaatctcgtggtgcaccgtttttcttaagccggtccgaaaagcgcaatattcggttgggagtgacccgattttccaggtgagtctgtcacccctttctttgacttggaaagggaactccttgaccccttgcgcttcccaagtgaggcaatgcctcgccctgcttcggctggcgcatggtgcgcgcacccactgacctgcgcccaccgtctggcactccctagtgagatgaacccagcacctcagatggaaatgcagaaatcacccgtcttctgcgtggctcacgctgggagctgtagactggagctgttcgtattcggccatcttggctcctcct

SEQ ID NO: 12781 - DNA, 48563 bp, Homo sapiens
tcattttttttttattatcatactttaagttttagggtacatgtgcactttgtgcaggttagttacatatgtatacatgtgcaatgctggtgtgctgcacccactaacgcgtcatctagcattaggtatatctcccaatgctatccctcccccctccccccaccccaccacagtccccagagtgtgatattccccttcctgtgtccatgtgatctcactgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgagatggctgggtcaaatggtatttctagttctagatccctgaggaatcgccacactgacttccacaatggttgaactagtttacattcccaccaacagtgtaaaagtgttcctatttctccacatcttctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagcagctctttagtttaattagatcccatttgtcaattttgtcttttgttgccattgcttttggtgttttggacatgaagtccttgcccacgcttatgtcctgaatggtaatgcctaggttttcttctagggcttttatggttttaggtctaacgtttaaatctttaatccatcttgaattaatttttgtataaggtgtaaggaagagatccagtttcagctttctacatatggctagccagttttcccagcaccatttattaaatagggaagcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaagtagtgtgatgcctccagctttgttcttttggcttaggattgacttggcgatgcgggctcttttttggttccatatgaactttaaagtagttttttccaattctgtgaagaaagtcattggtagcttgatggagatggcattgaatctatacattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattctgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggatttggtatcagaatgatgctggcctcataaaatgagttagggaggattccgtctctttctattgattggaatactttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcatcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttagggtggagagttctgtagatgtctattaggtccgcttggtgcagagctgagttcaattcctgggtatccttgttgactttctgtctcgttgatctgtctaatgttgacagtggggtgttaaactctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgccttttcttgttttccatttgcttggtagatcttcctccatccttttattttgagcctatgtgtgtctctgcacatgagatgggtttcctgaatacagcacactgatgggtcttgactctttatccaacttgccagtctgtgtcttttaattggagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttgtagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggttgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcatcttccattgccgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttgtttgcctttggtttgaatgtcctcccgtagctcagagtaatttgatcgtctgaagccttcttctctcagctcgtcaaaatcattctccatccagctttgttccgttgctggtgaggaactgcgtccctttggaggaggagaggcgctctgcgttttagagtttccagtttttctgctctgttttttccccatctttgtggttttatctacttttggtctttgatgatggtgatacacagatgggttttcggtgtggatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccagttctcagatctccagctgcgtgctgggagaaccactgctctattcaaagctgtcagacagggacacttaagtctgcagaggttactgctgtctttttgtttgtctgttccctgcccccagaggtggagcctacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagattctgtgggcgtaggaccctctgagccaggtgtgggatatagtctcgtggtgcgccgttttttaagccggtctgaaaagcgcaatattcgggtgggagtgacccgattttccaggtgcgtccgtcacccccttctttgactcggaaagagaactccctgaccccttgtgcttcccaggtgaggcaatgccttgccctgcttcggctcgcgcacggtgcgcgcacccactgacctgcgcccactgtctggcactccctagtgagatgaacccggtacctcagatggaaatgcagaaatcacccgtcttctgcatcgctcacactgggagctgtagactggagctgttcctattcggccatcttggctcctccagaatctactcatttttaagtgactatttcatttggagaaatggtcataaaagtcagttagcatttataattaaaactcagctttagttaaatttaattgtgtgtgcagcagagcatagaattcaatttcaaaatcctgaaccatattttatgacttgtcttcattagcagttattggaaatttgctatctctctacatgtattcctcatttaattcccacaactctaggaagtaggtactagtatgcccattttagaaatgagaaagctgagacatgaatagattaagaaacttaccctagaccagtgtttctcaaactttatgtgcaaaagaatcacccaagagtcttgataatttgcaaattctgacttggtaggtctggggtgaatcctgagattctgcatttttaatcagctcccaggtcaaggccaacactgttggcttgtggatcatacattgtgtaacaaggttctagattacatgtcctagggtcttaacactgcctgtctgacactgaaacccatgcacataacccctatgcagagtatgcattgacttttctctttactacattgtaatttacttcctacagatgaaacagttacattagttcttgatgcatatacatttgtgatgcaattttacccttgaggaatatccagggaagcaaagcattactgggaccatcatcctcatcctaaaggctctcttctacatctgcctcttctgggaccacagctcccaaaaggaaacatagaggtggcagtggcagctgacaatttaccttattctttggaatctcagggtttctcctgctcaatgagtgcagccattcaactttgacttctcctcctcgatcctcccgtgaatatgtagtatataaaatcatactatgcttcatgctttcttatgcatgtttatttaaatatatatattatatgcatgtgctttctttacttctcattttacttggtattcacagttcattttcttccagtaagtctttttatcctattctttgtttgtatccccaaactcttcctttgtggttacgctataattttaatatttaccaaaaaagaagattcaagttagacacttttcatattatattactttggttaaatcagcctggcctagaggatttccttttcaccattttctttctcatcaggtgaggtagtttgactgacttggtttgttcaagcaaaaggacaatgggaaataaatctaggtgttcagcataaaaacagctaatgacaaagctatttttagggacttcttgtctttcctatgttattctttatgtctgtttgatatctattttctggctcttatctttaaaagacagctgctttgcctcaggcataaatcagaagaggaaaaccagcttctggacctggagagaggatgaaagggaataggaattgagggaagcggaagggaagaataagggacccctggagagtccctaccaagccagacataacaaacaaaagtcctctactactgaggaagacagaacagggaagccagcaggggaagaaaaagatgctgctgctcttgatgcctcaaaaacagcaaggaagaacccaagcaactgatgtacacacccttggaacaaatctgccccagaagtacaagacacactcttcgaattcatggaataaatgggaggtgagtgttcaattccaagacacaagacagaattgggcaagagggaggaatgctactacttgtaagtcatagttacataaaaacagcaaccacattgtgtttttctgtaatgctctagatctgtggtccccaatatttttggcaccagggactggtttcctggaagacaatttttccactgactgatgattcaagcacattacatttattgggaactttatttctattattattacattgtaatatataatgaaataattatacaaaccataatgtagaattggtgggagacctgagcttgttttcctgtgactagagggtcccatctgggggtgatgggagacagtatcagatcatcaggcattagattctcataaggagtgtgaacctagacccctcgcatgcacagttcacaatagaattcgcactcctatgagaatctaatgctgctgctcatctgacagcgggtggagcttgggcagtaaagctctgtagccctgctgatcacttcctgctgtgcggcagggttcctagcaggccatagactggtaccagtctgtggcccagtggttgggacccctgctctagatttaagtgtttgtagatgaagcactttagctttcccggaaaatgtattgaagataaatttattcaaagttatcatacatttaaaaaaccccacaaaactcttaacccctgtaaccccagtaggtttgggaggccgagctgggaggattgcttgaggccaggagtttgagaccagcacaggtaatattgagaatctctgcttttacaaaacaactctcaaaattttatatgtacacacaaatttggacttcctgaattaaccagttaatagattttaaaatacacattaacccaagaggtaaataattcatcaaaattcagcaaaaataattacttgacaccagatagctagttttacattttccaattttttagccagttgctagaaatcacataaacacagtctgatttttataaatttggctgaaaaattgaaggactattatcaatttcagttaacgtttctttttaaaaattagcttaagtttgatattgaaaatataaagctttttaaaaattgaaatgctgcatgaaaggaataaaaatcatgttataatgttagtagagttctcaaccagctcactcatattttaacatactcttaccctaaggtattaaagagtggattatttaaatacaggtaaataaaagtgataggagttacagaaatggtgaaaagagggaatgctagcaattttgtggtggccaaataaaaacaatgtatttatcagtagataaaaatgtgcagattaattcttattttagatatctgtggcagctagaagtacaactttaggctcttcaagaatgacagttttgatttatattattctccacagctccatttaagtacactactatgctctctgcattccttttctcttacttgatggctaataggcattgccattccttgatatctctcaaagaaataaaactagaaggatttttaaggagcataaaaattcagctcccagctgtgtacacacacccatacacacacacactcacactcacgaagttagagagaagctcataaaaacaacaacaataaaaagccagggaatgtataaatgtagaacctgagtttctactgaatattcttaaacagaaactactaaactactgtaattgttgtgctaacagacagcactgatgtctgagtgagagtttaaatatatgaagattataagactatagataaatctgcatatatagcttttttttttttttgagacaagctctcactctgttgcccaggttggagtacagtgacacgatcatggtccactgcatcctcgacttcctgggctcaagcaatcctccctcctcagcctcccaagtagctgggactgtacgtgcatgccactacacccagctaattttctctagtttttgcagagatgaggtcttgctatattgcttaggctggtctcaaacctctgggctcaagagatccttctgccttagcctcccaaaatactgagattataggcgtgaaccaccatgcctggccacatatagcacttgtaaaaaaatgttatagtaatatatgcatgtggtacaaaattgaatggttatgcagtaatcagaaatccctctatcctaaccttcatccacccaatcctcctcctagaggcaaccacaattagcaatatcttgaatattttttcagagatacaacaagaaagattttaatctccctttagtccctcagttgaaacttaagaggtttagatttccgctgacttaaaaacaatgcaatggaattctggtctttggttcagatctgaaaacaacttccatttatcagtccagaaaactgagaacttactggttatatcactaatggttcaggattcctccttagaagagagttcttttctctagcaacaagataaatagctgatttcttggaagctgtcctttctttataggccctatttcattagttcattgcctggtaattacagctgcatggaaataaaaatgtaaaatgagtgtgatttccttttataggttgaataatatgggtagccctggattgtgaaaggaaacagattgctcctcggttttttttattatatccaaggtttcctatctgctttgggtgaattatcactagtcacctaaaaacacactgattaaaaaaaagggagaagtcacacatctccctcctgtgcaatgctgataaatttatacggctatttaaatagtcatatgaaatatcaattattaataacagcagtagatcttttgagttctaagagctttaaaactgatgatctctccaaaacatctataatttgcaactatttacagtacagcagaacgacctcatgaaaatatttatggctcttacagtgtcaaaattttgttttgttttggcatttacagcagttaactaaatgctagttctgtgttagttctcattgctataagtgtgggagtaaattgaaacaattgtgacaaacataccatgatggcaatgaacgatgaaaacattattttcattccctgcttacatcgaaatttttccaggtatcaaaccaagaggtggattactgggtgccatataggactctgcagctgaaagctccttttaattttggcagaacaaatagttatagtatacaatgatagaattgaaggtggaaatgtcacatctcagaaagtatgctaatagtattactagctatgaattattaccttcagtatgtgccagcaggaaatcacatagatctaaacatgttcaatacttgttttcctaggtcaaccatctaagatgttatttgtcattatttataaattatatttgaatttctgaatataaagcaatcaatttttctactatttaagctgaatttttattttcaaagctatgcacatacatagcttaaaaagtcaaatatttcacagggctaataatttaaaaacagcattcttctgttccttcccctgattattgctcctcagagaaaaccatttttaattccctcagctctttttcctggtgtctactgctataagtctaagaacactcatttaatgctattttttcaaatttttattatactgttggttaatttcttatttctaacccctgccctcctaccacctcaatcacagttaccttctccttctcttctcagtatagctacagctttatttggctaaaccaatgttcagttttcattatgaccaattagatatcattcatagctgatgcatgtagtatatcaggattgtaattatttcttctacactttgttttctgggtactttaaattgtatcttttaaaaaaatttttgctttgttttctgtgtgctcatggctaccagagtcatcctgtgttgcttcacaaagtgttgagttcctcttaatatagtctaacacttcaggaaatctcagtttccctgttgtcttgaagatacactttccaccctgctgctcctatctgggctgcttgtcttccccatctgcccctcagctgtcttcctgggatatcctgtcacatcatctgggatatttccttcaccttccttctgtctgagatccttattcctggatcccgagacttcctctttattgatttactctcttgtttctggtggggcatattttccagtagcttcctgagagactgcctgagaggtgaactttgagaccttgcccatctgaaaacgtcctgattctaccatcgcacgtaatttatagttagacagggtgtagaattctaggtttgcaatacttcattcttaaaatttgaagggattcttctactatgttgcaggtactagttttggtactgagacatctagtgccttcagattcatgcttgttggtatgtgacctgctttctcctttccacctctccagaagcttttagcatcttcttttctatttgtgatgttctgaagtttctcagtcatatgcatttataggactgtttttcttcccattgtgctggacaccttgtatcatggtgtcacctttcagtttggaaactcatgttttttagttctggaaaattttcttgaatcatttgttgaataccttcttcctcttctttattttttctgatttctttatgagactcccattatttggaagtcagatatcctggaaaaaaatgccataattctctttgacctttttgttgtcctgttctctctctctcacgtggcttgtgaacctaattgtaaacttgatcagtaaaaaccattgtggcagtgcaaaggcaaattcaaaattgttatctctggttatttttagtgttttttcagctatttcagttttgtcatttatcaatgtatcttatgtttttatattcctcaataaatatttgagtgccctacactgttttttcctgatgaattgaagctaggacaaactagagataatcagtaaattcattaaattgagttcaaattctgctccactcaaacttattccgtttattcattcaaacattaaaagaactacagtgtatgaagcagttagctgggtagtaggtacacaaaaataaatgaaaataaacaaaatgtctttttctttgtggaaattataaaatgtgaatgtatgtgtatggggatagatgggcaggggagtatcattgttactgcaatgggggtgagtacacatgttgttactgaagaaaaggaagctcatctaaccctggcttggggacaattcattcacactgtctgtggtctatagaatgggttggagggctcaggacagtcttggagacgaactaaaacaccaatgaataattcaggtgagatggtagtggtctgaattaggtctgtgacaagaaggagaaaagtgaattttgagacactaggagtttaattagataggacttgaatttcattgaattagaggaagtgaaagtgagttctaaggcagaagatagtgaatttaattttggaaaagtttaattttatgtgggatgtgcaagtggggatttgaatcagaagctcagaagggacagaagccctggaaatagattcttgggtgtcactcacatatggtactgtctggagccatgtgaattgagagcacaggaggaaagtgtgtcaactcaacaaggtcagagaaagtttgatgaagaaacctaagggaacatggagatttagaggctagaaagagaagaatatcccacatatgtcaagagaagagagggttaaagaaatgaatacttggcatgatcaaatgctaccatacattcatataaggctttatgatatgtgtgattttgcatatattttcttacttaatccctgtaatggctttatggttcatctatctcacttttccacttttttctaaaagtgtttagataagaaaacggaggcccaggaacacagcaatttgttcaagattacaaaagttggctgggtgtggtggcttagcctgtaatcctagcactttgggaggctgaggcaggcggatcatgaggtcaggagatcaagaccatcctggctaacatggtgaaaccctgtctctactacaaatacaaaaaacaattagctggacatgatggcacatacctgtagtcccagcaacttgggaggctgaggcaggagaattgctcgaacccgggaggcagaggttgcagtgagtcgagattgtactactgcactccagcctgggtgacagagcgggactctgtctaaaaaaaaaaagattacaaaagttgtgaaaagcaaactcgggtgttgaacagatttctggagtttctcaggtgcagagtggtgagtccagactgcaaagtggcgcagttaatgtgagccctcactgtgtgcaggcactgtgctgagtgctttgtgcacattatctcatttaattttcaaatcttatactataaacttgttaacattataatccccatttaaggaatgaggtagaggaagctcagaggttaagcaacctgcccaaagtcataaaaccagtaaatggtagaagcagaggaattcacgtccatttgctgtatgacacacgtattaacaattccatcattacgtatgaatttctttcatccaaagacttccctgattttttttttttttgcctactaatgcttctgggctgcataaagataaaaatctcaataaataatagttattttgaaaggcctacaatgtggtgaggtgctcaactaaataatttatttgtagtctattcactctttacaaacctgaatgggaaagtatttttacccccattttacagatgagaaaactgacccccagagattaaataacaatacacattgtacgcatgtttcaaaatatcacttgtacccttaaaaatttttttagaatcacatgggtcctataaatatgtacaaatattacatatcaaaatgtttttaattaaaaaaaataaggacagagtaggcattctagctcaaatccttttccttttcttcttctcttctttcttccttcctttcctcccttagccaaccctccttccccatctcctctatccttctctttcatttggcctactgcttcttaggtgacaataagagtgaatttagaatgaggcctttaggaatgggatataggtcaaggcactgggattcagaggagacaaggggtaagcactttgctagtgtaattgtaatgtttggaactcagttaaaatgttcaccagactctctggtgccctgatatacccacataggggcttgtgtgattgagaactaaggtttttagacatttagtttgaaatataattaactgtgtatatcaaagtttgtaatttgagactaataattgagaataaaattgatggataattaagtaaaataaaatatatcttagacataaagaataagataccttagtggtcattcataatttgtttcatttttatataaaaattatttgcttcccatacacaaaacctgagtgctcatctacttgatgatttatgacacagaactggagttacttatgtcaaagctctgctttgtttttttttcttcttttgagatggagttttgctcttgttgcccaggttggagtgcagtagtatgatctcggcttactgcaacctctgcctcctgagttcaagtcattctcctgcctcagcctcccaagtagctgggattacaggcgcttaccaccatgcctggctaattcttttatttttagtagagatggggtttcaccatgttggttaggctggtctcaaactcctgaccttagtgatccacctgccgcggcctcccgaagtgctgggattacaggtgtgagccactgcacccggcccgaagctctacttagaaggacagcagtgctctatgttcaagacagagcttttctctgtgcctcaaaaaccagttgaaaaagagcattgcaatattatgtgttaactgttctgtagaccaaaaatgttggttatattgatggcaaaacctgaaagaaatccacaacgcagaattaggtagatactgccccctctcccttggaactttatacattccgcatttttactaaaatgcttatgatgctgtttcacgatttgtttatatctctgctctgcaactttgaaatgcttgaaagcaaggtttaggtcatatgtttatctttgtaaccacagagtttagcacaaattatgtcctcaagtttacagatttaactaaccatagtcagggactcaaatattgtgtagccaggcatatgttctaaaccagaaattgtcccagtgttttcctcacttcacttaggatcacatatggtgtttttttttttttttttaatacagagtctcgctcttgtcacctagggtggagtgcagtggcacgataatggctcactgcagcctcaaccttctaggctcaagtgatcctcctacctcagcctcctgagtagctaggactacaggcatgcaccattactagataatttttatattttttgtagagacaggatcttgctatgttgcccagactagtctccagcttctgggctcaagtgatcctgctgcctcagcctctcaaagtgctggaattacaggtgtgagccaccacacctacccacttagcatcctgtacaaattttactgttaaagaattttatgttttaatagacttctaccaagcaaactacaattttaaaaataatctctggcttctgttcattgttgatacatacatatacaatactggttgaaaaattccaaccaagaatgaagaaatgtgatgttttggttagccttggtaatgctattgtggttaactagtattcttatttaaccatgtgaactactaaagtatcattcaacttcattttttaactgtatcatttattttaaagatttatccctattgatatagctaaacttaagcccattcttccttaaaaacatgcattagaatgtcaaacctctaatacaggtttagtggttacacctgggaagagaggagggcagagatgagggtagatatgtttctatttctgtaatgctttatttctttaagaaaaaatctgaagcaaatatggcaaaatataaacctgttaaatgtggctggtgggtacatatctatctaattcattttctgtatgtttgaaaatttcatactttaaaaagtgaaacagctgatttcaaatgcctcttttaaacaagcacccatgtaaaatggcattaatacatttacttatttttaaaaagttaaaaaaaattctaagattgaaaacatttgcccttaactttagaaaaactttaaaagcatcagagtaaatatagaattctaattatagacaatagaaaaagacagatcaagagagatttgaagctctcaaaaattgaaattttgatatttaaagttaagatttcattaaagcctatgcatcctaaattaccacctgtacttagacaactcaatgtttagtatagacatttgtaaattccagacactcacacccaacagtctgctttacagtttttctctgagccccatatgatccaaacgaaagtcatgggcccctgcactgtctttaatgtaatacacataaacctagttctcttattccagtgactggagtcatgcaagtcagaaacccagggaagtttcttaattgccacgccttacaatgttaatattacttcatcacatgggttttttttttacagcagtcttttaaagattatgtctattttatgaagattatttcagttaaactagcactatattcataaagctacttaacctggcatacataaacagaggcacagtcaatatgtgaaagtcaacactgtggaacgctcatcctttccttacattacctcagctaccctaaatgagtcatgacacctgtcatactgactaagtgaatccctaggataaatattaatgaagcttaagtttttaatatgtgtttgtacaagtttgaacactttgtccttgctgtccagtggaacatcttgtatactccatattggagactgcaactctatactgtggtcagaatatttttgaaactcaaaatgattatgtttctctttcctccctatccttcatatattaaccttccagagacttcctatttgctctaaatatgaagaccaaaatctttagcatggcgtttggtcaagtcttttcacaatttgtcctctatctccctcttcagcctcaccttaccaaaagctaacccttgctctttgatacaaagatatgaagaaatgcacctccctatggtttgatcgtagcacttatttcagttgtaattttacttgcatattttattgtttgtttagtatctacctcctataccacaagctatgtaagttattttaagaagtaaacaatcaaaatgagaaagaagataaagcaatttctcaaaagattgatattttcacaagacatcggccaatgaacctagataaaagatcatgtgtaaaaacaccaaagggtcaaacgatgggaaaatataaaaaataatatttattgtttataagaagaaaatagaggctttaaaaaatatcttatttccacttttttttaggctttttaaaattagaaaaaataataaaaaatggccataactttattttggagaaaggctcagacccaccactttgagctgatggtataaaattatagatgacagtgacaaaactattcaatgtttatttctttatcagtattgccatttagatatgctgattatgaaatattgcctagctgttctttatagttgttctttatagattctttatatatatatatacacacacaatatatatacatacatattggccatacatatatatatggccaagatgaattataactttaggaacagaaaaaattagcagatggattttataaaccaataatatatatatataagtatatacatatgtatttaaggaactgcaatttgctttttaaattaaaaaattaaactagtttcaaacctatagaaatgttgccggaatagaacaaaattatttttttattttcagacagggtcttgctctgtcacccaggctgaagtgagacggagtgatcatgggtcactgcaaccttgacctcctgagctcgagctatcctcctctctcatcctctcaagtaattggtgccattgtgcccagccaaatttttaatagtttatagagatggggtcttactttgttgctaaggttgttctcaaacttctggcctccagcaatattcctagcttagcttcccatagcgctgggattatagatgtgagccaccttgcccggcttgaacaaagcaatcgtttttgtttggatgattgcttaatattttactatgtgtatatatatttattgcttctctctctctcccccaatctgatgtccctctactccctaaatacttcagtatatacatgccctaaactgggacactctgctgtaatagtatcaatatacttggctgccaataagaaaatcaaagttgatagaacactaccattgaatccacaaactttgatcatattttgccaactgtcccaacaatgttttctcctctttttggtccagtatcctatacaggaaattgcattgcatttagtggtcatgcctctttagattccttcaatttggaacattttgttatttcactctctctcaagtccctgggttttaaagaatggattccttttattctatgggacaaccctaaacacaggtctgtctgatgtttcctcatgaccagacacaagtcatgcatttgtggcaggaatatcacagaagtgatgctgtgctcttcctagtgcctcatatccggaggcaccacacaatgttgatctgttccactgcttgatcttgggtgcctgtttatgttagtgtttactagatttccaaaggctcaatttttctttaagaccaattaacatttgaaggcaagacttctaagattttacactaatatcccgtttctcatcgagtttcccacaccagcaattgcattcattgacaatttccacctgagccaaccatcataatgagggttgccaaatggctgcttatttgcttctttctacaattattagttgatactctactataacagtacatttctcttctcacatttctttattatttatattagtgtggattcatggattccagttttagttactgagttttcatttgataatattattatttattgtgatgtggatattatcccagatttgaccagttttatccctgttaaactggcttctgtatccttttgacatatctccatcactcattgtatatgttttttagagataacaaaatgcaccaggtacattttttcattccatattccagccctggcattagccatttcttaaaggacccttgatttcttttaataaaggataatattcattaaaggaatgaaacaatgacctgggtcacctggagttagccatttcttaaagaacccttggtttatttatttatttattttttgagatggagtcttgctctgtcacccaggctagagtgcagtggcacgatctccattcactgcaacttctgcctcttgggttcaagtgattctcctgcctcagcctcccgagtagctggggttacaggcatgtgccaccacgcccaggtactttttgtatttttagtagagacagggtttcaccatgttggctaggctggtctcaaactcttgacctgaagtgatccacctgctttggcctcccaaagtgctgggattactggcgtgagccaccatgcccagccaacccttgatttcttttaatgaaggataccatttattaaaagaatgaaacaatgatctgggtgctcatgttcatcattaccgaggtgtcattgcattgggaattttcagtagaaagagctagaaaatgttgtatgtatatacgcatgtacatgtgtatgtatacgagcatatgattgtaactatttttatttatgtacatgtgtatgtgtgtgtgtgtgtgtgtgtgtgtgttttcatacctgacttgatgctgatacttttaattctaatcgtataccttggggttctttttatttattatgtgttttatttttagagacagagtcttactctgctgcccaggctggagtgcaatggtgcgatcatgactcactgcagtctcgaactcctgggctcaagcgatccttctgcctcagctccccagtagctgggactacagccatgtgccaccatgcgcagctaatgttttttattttatgtagatcgggtgtcactgtgttgcccaggctggtctcaaattcctggcctcaagtgatcttcccgcctcagcctcccaaaatgctgggattacaggcatgagccactgtgcccagccaagattcattttagtctgcttcctttacatggtgcaaattccttctcagatattaagaaatatagtttttaatatcttcacctctttcctttcttccctcttccttctttctttcctccttttttttcttttttgtttcctccatttcttcctttctttcttccttccttccaagacatagggtcttgctgtgttgcccagactggacttgaacttctgagttcacatcatctttcctccttagactccagaatagctggaattacaaacatgtgccactgcgcccaactgcagtagtcttctaattggtttccctgcttcttcacttgctcccatatggccaattccctatataaagctagagagattttctaaaacataaatcatatgtctcttctctgctaaaagtgtgccaatggcttcccactaaagttagaaaaaaaaatctttgaaactaaagattggactgtcttaaaagcaaacagactatataacaggcacatgtcttaatctgtttgctataacaaaataccacagactgagcaatttacaaacaacagaaatttatttccgacagttctggaggctaaaaagtccaagatcaaggtactggcactggtgcatgttaagacctgctccctgcttccaagatggcaccttgttgccatgtcgtcatgtggcagaaggtggaaaggcaaggctttcttcaacctagagccctttttaataatggttctaatgccatttagaagggcaggaccctcatgacttaatcacttcccaaagtccacatctcttaatactgttgcattgaggattaagcttcaacctgaactttgaaggggacatagcagcatagtagacttttaatgaatattcaccaattgaaagaataaattagaatttcaaaacaaattgaaaatgaagaaagtaaaggtatacactctcctatctctatcacacccacatccaaacagaagatgctcttagatctaatatcagcgttttcagaattggattactttgctattgtctctattcccaccatggatcatgctcccatcatatcttcagtattgcttgcattttcacgatagttccctaactgttatttcagtttctgcccttgcctcccttcactctattttcacagaggccagaataattcggttaaaaaatgccagatcacatcacttctctcttaaaacccttcagtggctttccgttttactctgggtaaaagccaaagtgctttaaatggccaacaggccctgtattcattatctgttgctatgtaacaaagtactcaaaacttagttgcgtcaaaacatacatttattatctcatggtttctgtgggtcaggcatctgggcccaggctctcttgtatggctgcaatcaatttatcagctggggctgaattgttgaaaggcctgactgagggaggttctgatttcaagctcacattgctgttgtcaggctccggtcccctgctgattgttggctggagacatcagttctttgtcatgtggcccaatccatacgactgtttacaacatggtagcttgcttcccccagagtaagggctgtgtgtgtgagggagagaaagacagatattccctaatgtcttttgagtctttatacttttctatggcatttattgtatccaatatctcatgtgttttactcattgtctgtttcctcatttctctatcctcattacaatataagctataatagagcaggacatcttgcttgtttcactgactattttatctacagtgatcagaacagtgttaaacacattcaaaacaaatactgaataaatgcaatcatttcagaaaagatttgaggaatctcaaaaacagacatccatctgctatgaaaccctgtaacatacagaattactgtaaaaggctgtagtgtattcatgaaacagaatccagagattactgtataggaagaaaaaaattagaacagtcctaccaaacatacaccaaaaagcaaacaaaaattcagcaatatacaaagaatattattagtatttaatatatatacacataaacacaaagactgtcatacagattttgtcatatgtggttatgtataaccaccaataatcaccaattttcaagttcagttcttggtcttggagtcaatgatagatctgtacccttcatgacagcacaagagacctgggtttttggggtagatgcagcattcctttcttctcttagaaatacattgcacctgaaagggaaaatggtcaaccccactgtattttttccagattatgagctcctccttagaagccagccaagcatgcccagatgatgggttaaggctactgagctttccatggtgctagtgcagtttgcagtcttgctgtatttcatagttgccccacagaatttatttccctgtcagccatggacagctgtatgaattgacatctcagagggtatctgccaagtctctggaaatgctaatgcccatgctgattaggttggacaatgtcaacttgttctgggcatcaatccattgagctacaagcttctcatgatgggaaaagagggcttcctgaagagaagtagacagcatgctcaaactgctaagaagggtgatgacaaagctcctgctaaggccctggttcttttaggaattatcctcatattgtcagctcaggctatggtttgggctgtgagatctcatcttccttcatcttctgtggacccactggcttgccaagacctctttaggaacgaagcagtctgaggaagtgcagtctgagggtctgtcatttctatagaagcagctggagatattgggaaaatgggccaggattgtggcttctccagactgcaacagagcaggacaggaatttttctctgctccaaatctcagcccctcaccatgtccctgcctaaacaacaaacacatacattctttttttcacttccgcttttgcttctgcatcagttgtttttcttttacaaactgtcaagatcctattgatcagcatccaattcatttaattatgcaatccagttatcttgtatcacctaggaaaagtacatataagactgtcttaaaataaaagactagtgacaataaagattttttgcccaacagaggccattgaaggatacacttcctctttaaatcatgtgaaattcatcctggaatgcttttctcatagaatatactcatttctttcatatctgaaccatagctgaagtagtagattcccatgcttttcctcctgtctcatttttcttttttgtagctcctggccacagtgggagccatgatctctctcctttacatgtggctgtattcccagagctttcatttccatgtggcacatttttatgctcattttgggtaccccagtgctcagcatattgttaggcaaagatacgtgaaaagtaaggtaactttgtttctctggtgctattccactgggggaaaagaggtggggagagatttgctggttagagttctaaaagtaatggcaaaaaccacaattaactttgcaccaacctaatatatctgtaggcttataggttttagcattaagcagttaattgagtccgtttttaaaaatataatatcttttgtttacctaggagctggtgtagtgaaggatgaagagaaggcaatgcattggtttaggtaagatgatgacatctgcccaaaagcaaagcttcagagttacctgttcagaaagtacaggttgagcatcccttatccgagatgcttgagaccagaagtgttttggatcttggattttttttaatttttttattttgaaatatttgtattatactaactggttgagcatccctaacctgaaaattcagaatctgaaatgctccagtgagatttttctttgagggtcatgttggtgctccaaaactttcagattttggagcattcagattcagattttctgattagggatgctcaacctatgctgaaatagaaaaccttataattttggtgctctttccctagagcaaaaataagctagagatcttaatattaaagtcttggtaccctttttactttttccacttggtgatgaggtaggagtactggtggagctatggagagggcggggccaatgcattttaaaacagtctacacaatgtaagcaaagagcagattagattcaaaagagccaaactggggaacgtggaccaatctaggtcaagattcagaatatcaataagtttattaacaatgttctgtgttaacgttactttggttattaaggttttgagctcttgactataaaacatacactaatttgaaatttacaaactgggctacatgttagaatcacctggggagcttctgaaaaatgctgatgcccagctccagattgatttaaatgagcagaaaatgattcctaggtgagtgtaatatgctgccagctcaaactactccagaagtctataatggttaataaagtaaacatgaaccagcagaagaaggcatttcaggaacatattctaaagcttaaaatcgatattctgataaagttcacctgacaacagaagaaacacctttgagaatcaggaagggagtgacatggttccaaagtggcaaagtgtcgttggtgattaactgcacttggctgaagtgcttgccactgggagtatagtccgtacacccagagcattggcatcgccaggtgggcacttggtaggaatgcagtctctgaggctctaacacagacccactgaagtagaatcttcattttaataagttcctggggtgactgatatgcactctccgatattgtagccaacagccacaatgtggccatataaatgtaaatgaattaaaactaaataaaatcagaattttagttcatagttgcactgtctacatttcaagtattcaatagccagtactggctactgtactggacagtgcaaatatagatcgattctatctttggtaaaaattctactggaaagtactagcaatttacatttatgtttcagcaattggaaatagtgcttaagggtcagtttacgtgttattgaatttctaacattcccagatagtcctttccagcattttgattgcctgtatagtttggagaaaagagtataattatattaatatttggaaaagctgatgaattgattgaaacaaatacgcaactaatttttttaaaagtactgtacttgtttcaagtaagaaaaacattttttttttttttgagacagagtctccctctgtcacccaggctggaatgcagtggcgtgatctcagctcactacaacctcctcctcctgggttcaagcaagcctcagcctcccaagtagctgggattataggcatgtgccaccatgctcggctaattttttttttattttcagtagagactgggggttagtcagggttctctagagggacagaactaataggatagatatttatatataaaggggagttattaagtagtattaactaacatgatctcaagtcccacagtaggccatctgcaagctgagaagcaaggaagcctgtctgagtccccaagctgaagaacttggagtccaatgcttaagggcaggaagcatccagcatgggagaaagatgtagcctgggaggctaagccaatctagccttttcacatttttctgcctgcttttatcctagctgcgacagcagctgattagattgtgcccacccagattaagggtgggtctgcctttcccagcccactaactcaaatgttaatctcctttggcaacaccctcacagacacacccaggatcaatcctttgcatccctcaatccaatcaagttgacactcagtattaaccatcacaagtccaccccttgtcaactttaaccgatacacatctcctgagatcatacataatcttcaaataaaagcaataataagctcataattatgcctaacataatgcaactatccttcatacagccagaaatgcaccactccccaacccaaatactcttacataaagttaatgatgctcgaatgctgatatgaagtaaataaatcttatgtcacatgataaacgaaaaaggaaataaaatgaagttattttcttagtacaagtgtatatatgcacacacatgtttttaacaaaagaaggaggaaatactcatgacaattacagtctccatttctgcaactggtcacggggccattgatgattaccttcttctactacccattcgtatttcctttaccttcatcaagcaccttagcagatcatggtttttttcctaccttcttctgctactcattcgtatttcctttgccttcatcaagcaccttagcaggtcatggtttttttcttggtggagtgacccaaaccttcattcctgaatggtctgggccaactgcctggattgggctattgtagtttcccattgaccttaatcacaaagcatgataatactaagagacatcctaagggatctcctgtattccatacatactcttccttacctctgttgtggagtagtagactgacttcatcttgatagcccgggtcaatcaccctagccaacactgtaactcacttcttagcctgttgacttaaaggtaggaggagcctaaagtgtccagttggcaatcttaacttctagtttaatggaatcactgtgtctcctggtggcaacatttctcccactggaactaagacctctaggccagcagaatgtaatgtcatggaaacaggaagcaaaaattttgttagtggatcactaggggtgatggtgagtggtgccacttccatttccaacccttgattcctggacccatgaatcctggctatgggagaaacagtaccatatattgaatgctgattcagagcatacatggccttttggagaactttgccccagccctggcaaagtattgtcacctagttggcattgtaattgtgacttcaaaagggcattccaccattctatcaatacagctgcttcaggataatggggaacatggtaagaccaatgaattccatgagcacaagtccactgctgcacttctttagccataaagtgagtgccttggtcagaggcaataccatgactgtggataaggcattccgtgagcccatggatggtagtcttggcagaatcattgcatgcaggataggcaaacccatatctggagtaagtgtctattccagtgaggacaaacctctgccctttccgtgatggaagaggtccaatataatcaagttgctaccaggtagctggctgatcaccccgaggaattttgccatatcgagagcttagtgttggtctctgttgctggcaaattgggcactcggcagtggccgtagccagggcagccttggtgagtggaggtccatattgctgagcccatgtgtaacctccacacctgccaccatggccatgttgttcatgggcccattgggcaatgacaggagtggctggggaaagaggctgagtggtaaccacagaatgggtcatcttatccacttgattattaaacttctcctctgctgagatacttgtaggtgagcactcacatgggatacaaatacagtttttgatcacctagagaggtctatccacatacatctttctcaaatttctttgtcaccaattttccaatcatacttcttccaagtctctgaccatctagccaaaccattggctacagcccatgattcagtatataattgcatatctggccatttctccttccatgcaaagtgtacaactaggtgaactgcttgaagttctcctcactgggaagatttcccttcactgctgtccttcagggatgtcctagaaaggggctgtagtgctgcagctgtccactttcaggtggtgcttgtgtatcgtgcaaaaccatctgtcttctcttaaaaaaaccctagtcttctcttcctctgtcaactgatcatagggaactgcccataaggccattggtgtatgctgtgggagagaagatagggtggcaggagtggagaccatgagcatttgaaccacttcctcatgtaacttacttgtgccttcaggacccactcgagcccaatcacgtatataccacttccatttaataatgtaatgctgctgtgcatgacttactttatagctaaatgggtcataaagcactcagttcatgataggcagttcaggtcacatgatgacttgatgacccatcattaaacattcagttcccaccaaaacccagtaacaggccaagagctgtcactcaaaaggagagtagttatctacagaagttggcagggccttgctccaaaatcctggagacctccactgtgattcatctatgggggcctggcaaaggctccaaacagcacccctatctgccactgacccctcaaacaccattgaatctgctgggtcatatggtccaagtggcagagcagcttgcacagcagcctggacctgttgtggagccttctcctgttctggaccccactcaaaactggcagccttttgggtcactggataaatgggccagagtaacacacccaaatgaggaatgtgttgcctccaaaatcctaataggcccactaggcattgtgcctcttttttggttgtaggaggggccaaatgcagcaacttatccttcacctcagaaggaatatcttgacaggccccacaccactggatccctagaaatttgactgaggtagaagctgcctgaatttttgttagatgtatttcccatcctctggcatgcaaatgtctcaccaataagtccagtgtgtttgctacttcttgcccactggatccaatcagcataatgtcatcaatgtaatggacaagtttgatatcttgtggaagcgaaaggcgatcaagtgctctccgaataagattatgacacaaaggcagagagttgatatacccctgaggtaggacagaaaaaggtatattgctggccttaccagctgaaggcaaattgcttctggggggctttatggacaggaatggagaaaaaggcatctgcgaagtcagtggctgcataccaggtaccagatgtgctaatttgctcaagcaatgaaaccacatctggtacagttgctgcagttggagtcaccacttggtaaagcttacagtaatccacggtcattcttcaagatccatctgtcttctgcactggccaaataggagagttgaattaggttgttgtgtggatcaccacccctgtgtccttcaagactttgatggtggcgctaatctctgcaatccctgcagggatgcgatattgtttttgatttactatttttctaggtagaggcagttctaatggcttccatttggcctttcccaccataatagccctcaccctaccagtcagggagccaatgtgggggttctgccagctactaagtatgtctatgccaattatgcattctggcactggagaaataaccacaggatgagtccagggacccaatggacccactgtatgttggacctgagctaaaactccattaattacctgacctccctaagcctctactttaactggagaaccacaatgacattttgggtccactggaatcaacttcagctcagagccagtgtccagtagttccccaaatgtctgatcatttctctttccccagtgcacagttaccctggcaaaaggccagaggtcgacttggggaaggatgggagaaaaattaacagcataagttgtcagtagtgtagtggggtccttccttaaggggacatgtcctccccttcattcaaggggctctgggcctgcaaactggctcaagtctggaaattgattgagggatcatgattctctgtttttataattcaaattagtcttttgtccattccatctggaagttttctgcttgtctaaattgagtaggaatgcagtacacttcccatcaatttcacttctaggaacactgtgattaattagccattgccagagctctacacaagtcagaatattctaatttctgctttgcctctgctgtccattatagtagctatgcccaccttgcctttgatggttaagtgccatcacttggcctctgccaccttgggatccaattattctcattctatttaaattttgtagttgagtgactgccattcccactgttagatctgccacacggagaagagcaattacaggactcttcaaaggtgcagatgctgccctcacaaatctattttgcaatgcattggtcaagggtatatcttctggaccctcccaattgaaatatataggtctaaagtgactccagcatcctaatctccctaagcctttggatcccttcctctacattaaaccaagggagatcaggcatttccagctcgctcacagtgggccatcgtttaatcatatttcagctaactaagcaaataaactattgaatcttttttaactccccaagctgcaacattaaatgcagaatccctgcttagtggacccaaatcaataaattcagcctgatacaactctatttttttccaacattacaccacacgcttactatccattcccatgcctgttctccagatttctgtttacataaattacaaaactcaagcagttctttttgaatgttgcacaccgcctcctggatcacactctgaacctcacatctagaggcctgccaggactttagttataggtctagaggcaaacaggggtattgggggtggctcctgaggagaatcaacattatcttgcctggcaactgcctcaggggaagccatcactgttgcctcaggcagcatagggtttacctcctcagacaaaggtggaaagactgatggcagcatgggttggggaggggatgttgccactactggggatttggcaattgtttcttctggcaaaaaagtttcatcagaatttacaaacacagtgtccccagtttcatcagggtcctcccacacatcctcattccaagttgcagggtcccattcttttccaatcaatgccctcattttaatagtagacacctggaaaggccgtgcatgcacctttcattgcaggtcagccactcatgagaagagcttgtgtctgtttttttgcaatttcagctctttctctacaggagataagactcaggacaatcttggcagacttgaggctcagtatctgcttctgaagccaggagttagaatctctaacttcataattttctttcatcactttgtccactgaacttaggagcaaccaaccaacttcattatgttccttggtccttcacatatggtcaaaggtattatgtatagagtcactagactccttgcctctcatgagcagtgaatcaggagtgtcaaatgcatgtattttgcataactctctaaacagttcatgccaaggactatcagtgttctccatagttttagaagtagagtccttagcattttggggtctaatcatattaagcagtgaactccataaaccccaaaaccatccttaatattctgttcctctggaaccactcctggtaccaaaatctgtattagtcagggttttctagagggaagaactaataggagatatatgtgtgtgtgtgtgtgtgtgtgtgtgtgtgtgtatgggagttattaagcagtattaactcacccaatcacaaggtcccacaataggccatctgcaagctgagcagcaaggaagacagtctgaatcccaaagctgaagaacttggagttcgatgtttgagggcaggaagcatccagaatgaaaaaagagtagattgggaagctaagtcagctagccttttcatgcacttctgcctgcttttatcctagctgctctggcagctgatcagattgtgcccacccagattaagggtgggtctgcctttcccagcccactgatttaaatgttaatctcctttggcaacaccctcacagacacacccaggatcaatactttgcatccctccgtccaatcaagttgacagtattaaccatcacacagggtttcaccatttggccaggctagtctcgaactcctgacctcaaatgatacacccacctagacctttcaaagtgctgggattatgggcatgagccaccatatctggccaagaaaaacatttttaatgaaggaggcttattattttttggctagatatatggtaagatagaagtaatggtttctagtaatagtctttattggtgctgtccttggttttatgaaggggatgcttttttataaggttgtttctttgttttctatagcatgcttccccccatcaccagttccctttcttcttcctccttttcagacaagcctcccagcaggaccatcctggtgctgcctttaaccttgcagtaggaacactgaaaaacatgactgcctccatggaagcagggtaataaaatttgctgtcttttcccttctagctgacatgtcattctttccaaagatgcccctcatatactacctgcaattcacaggcaaaaacattttttatatagctcactttctgctcttgcctttctatgttcttacattgctgagttacaataaaagtcacaaagcaagggaatgcaatattcatatatgtgcatatatcccactgactaaattcttcaggcattctgtgagcctgagatgaaatgctgggttatttcatggtcctcacactctcctgtgaattcttatggcccccttaaatatcatctttacagccttaccacattttcttataaacagaatagagcagacacgaatataaggtagagaactctctttgggcacaaatatctttagtgtctgttggactaatcctcttgattactcacagttataaaaataaatataccactactttctctggagaagattttcttaatgcttttgaatagttcatagtctatgacatttttattcagctattttgagtcagacacattttttgatagggtcccgaaaacaaaccattaaactttcagcttgttttctctttttttaaagtaatgcaactgacatctacttcatttccaattaatgtgtacaacaacctcctgcaactccagcatttaatcttctacctcaggctaagaggtagaccaggtttagaaaaaaagttcagtaaggggctgaggatggggtgaatctttggaatttgtacaatagtcagggatgttgcctgcacaattggtaataaaattttgaaatgaccattttgaggcagccaagtcaaaatggcgaagccaatatgttctactttacaactgacggttaccagatgggaggttgtatagaatccctctccagttagcactcccaaaccaaaatatagaatttgcttgcaagagaggggtgcctccaacattacatgagattcttggctagaaaaacttctctaaatagggcaaaataatctagctaggctctggtcttttaagaatatttatttgggtagctctgattgtattatgaagattcttgtattagtccattctcatgatgctatgaagaaatacacgagactgggtaattaataaagaaaagaggtttaattgactcagttctgcatggctgggaaggcttcaggaagcttacaatcatggcagaaggggaagcaaacacgtccttcttcacaaggtggtaggagagagaagaatgagagctgagtaaagggggaagcctcttataaaaccatcagatcttgtgagaacttactatcacaagaatagcatgggggaaaccacccccatgattcaattacctcccactgggtccctctcataacacatgaggattatgggaactaccagtaaagagggagactcaaccataccatatcattctgccccatcccctcccaaatctcatcctcacatttcaaaatacaatcatgcccttccaacagtcccccaaagtcttaactcattccagtattaactcaaaagtccaagtccaaagtctcatctgagacaaggcaagttatttctgcctatgagcctgtaaaatcaaaagcaagttagttacttcctagataacaataggggtacagacattgggtaaatacacccattccaaaatagaaaaattgaccaaaacaaaggggctaccagccttatgcaaatctgaaatctgatagggccctcattaaaccttaaagttccaaaatgatctccattgattgcatgtctcatatccaggtcatacttacgccagaggtgggctcccacagccttgggcatctccgcccctgtggctttgcagggtacagccacccctcctggcttgtttcatgggctggcattgaatgtggcttttccaggtacaaagtgcaagcggccagtggatctaccattctggggtctggaaaatggtggccgtcttctcatagttccactactcagtgccccagtgaggactctgtgtgggggctctgaccccacatttcccttccacactgccgcagcagaggttatccatgggagccctgccatgtagcaaacttttgcctggacgtccaggcatttccgtatatcttctgaaatctaggtggaggtttccaaaactcagttcttgacttctgtgcacccacaggctcaacaccacatggaagctgccaaggtttggggcttgcaccctctgaagccatagcctgacatgtaccttggctccttttagccatggctggagcggcaagcacacagggcaccaaatccctaggctgcacacagcagggggtccctgggaccagcccaggaaaccacttttttctcatagggctctgggtgtgtgatgggaggggcttacatgaaggtctctgacatgtcctggatacagtttccccattgtcttggtaattaacattgggctccttgttacttatgcaaatttatgcagtgggcttaaatttctcctcagaaaatggggttttcttttctatcactttgtttggctgcaaattttccaaacttttatgtactgttttctctttaacattttgctacttagaaatttcttctgctagataccctaaatcatctctctcaagttcaaagttccacagatctctaggtcaggggcaaaatgcctccagtctctttgcacggcaacagtgacctttactccaattgccaacaagttcctcatctccatatgagaccacctcagcctagacttcattgtccatatcaatattagcagtttggttgaagcctttcaacaagtctctaggaagtttcaaactttcccacattttcctgtcttcttctgagcccttcaaactgtttcagcctctgcctgttacccagttccaaagttgcttccacattttcaggtatctttacagcagtgccccactcctggtaccaatttactatattagtttgttaatatgccactctgaagaaataactgagactgggtaatttataaaggaaagaggtttaatcgactcacagttctgcatggctgggaaggcctcaggaaacttacaatcatggcaaaaggggaagcaaacacatcctcttcacaaggcagcaggagagagaagaattagagatgagcaaaggtagaagccccttataaaacaatcagctatcacgagaacttactcacgatcatgaaaatagcatgggggaaactgccctcatgattcaaatacctcccattgggtccctctcatgacacatggggattatgggaactacaattcaagatgagattttggtggggacacagccaaactatatcagtactcatgatgaaacccaggtgaaatggcaagtgtttccctcatcaccttacaatgagtttaaacagctggtactctggcccttaactcaaactcttgaatgtgcaggtgcttttggtttactctttcttagcactactaaataactgtttcttctagggatgtagaaatgctccttaatgttgctgcaaaatgggggatccaagaagcccaagaacttctggagaatgttatttggactaaaagcaagctcttgccaactgaaagaaccaggagttcttataaaccataatgtgtgcctgcatgctcttcctggaacatgggatgttctgctctcacttgtccactgtggccttgcaatgctttgtggcattttcaatggaagctccttttacttatagtctcatatgctgctgcagcattaatttgctggttaaaatcctttaaatgaagtgttacttatatgttttcctgggatctgagtttgatctcttctggatagaggaatattttatttgggtttcattactgctcacttcagctaaagtttcattcaagccagtgagcattctataacgtggtaagtggaaaataacgaagaaacctgtcataccagagattggcttcttggatgtgttagctggcactcacagatccactgaaagagctagactcatcattagcctaatctatgacatgtgatgttctgcctaaaataagcctgttttcatttctctccatttcaattttctgctctattaggtttctatagtattttattacactcactttttgtattatagaaagtcctttataggggtaaaaaggctgttattgttgtcaattaaagggaaaaggataaagtataagacctaacaattattgaccatctgccacatgcaagatattttcttagctgtttaacatatatatatatatttgagactgagtttcgctcttgttgctcaggctggagtacaatggcatgatctctactcactgcaacctcagcctctcaggttcaggatgttatcctgcctcagcctcctgagtagctgggattacatgcgtgcaccatcacatccggctagttttttcatttttagtagagacggggtttcaccatgttggtcaggctggtcttgaacttctgacctcaggtgatctacctgccctgccctcccaaaatgctgggattacaggagtgagccaccacgtctggcctgcttaacaaatattttaacattcactagttataaaagtcttataaggtggatcttataactcctattttacagagtgaaaacaggtgtagagaagttgtgatatgtgcaaagtcacagagtgagtgatagagtggggtttttagtgctggcagtctgattctagagtcaacattcttaaccagttctaccaacattactctcccaagtcattaacatctctttcctaacaacaaagatgttctaagaacagataactgggtttattactggcatatggtgaacacttatcttagcaaataactcagccccattttctgactatgatttttttaaggacaaaccacgtagtcctattcttcaaaagtgatgtttttaaccttaattataattagctgtatttatctcatttagattatagcgcaattttctccttggaatatacatacagaaacacaaattgagggtgacaaaagtgtcaaactggaattcaatatgatgattaagctgtgtttaaaatatttgtttcccttttgattgccttgtttacactgtatacatatggaatatgactgtaagccttcagcaatcttctctttgtccaacgtgaacacataaacctttaaagatgtacatgaaatggtcacatgcaattttaaattctttaatgtagaaaatcccaaattcataaactaaattcttcacgtgaacctttggtaatagtatttttatcttctctagaagcacttatttttcttacatttttcccagagaaaccagtcttcatttcagtttatgttgttcaagatacaactctggaaattttattctgtgccacaaacacttataaaatactaggacaataatttcaatcatcgtgttagtgtgcatttttttaaccttcacagtaatatcctcttaactgtcttgtaatttaaatgcttgtttacagtaacaacccaaacttacaagtatgaaaatataccataggaatatgatcactaaatagtgtttttttattttaaaaaattcctttaggtgtcttctataaacatctccaactaacattgatttaggttgttttagggttctaatgtcttctaacagttctttgttgttgaaataaagtaatagagtagttgaaaaagcataacaacaattagaaagactttgtaaagcctcacatataaaaccccttcacttttaacttcggtaatacttgggtttaagatcgggaataacctaccagtccatcagggttgaaaaataatgcttcatgcaaaaccagaaaatgtgatggatgaggattcccctgaatccaaagctctgcttctacttcctttgctgtatctgggcaaaaattcaggggaaaagcaagacataagaaagaaattggatcataaagagagtgagagcatgagagaatgagaatggatttgcatgtgtttggccggttcagataccccaggttctgcttgctttcttccttccctgtgctccttctgggccacagaggttgagaacctctgcactcttttagatgccccaggtttcctatttagccatttgatgtcttgatcctttttctcaaggtctgccttaatgttaatataaaaatattttacattaaatatgacatatatttacagtacacatatcttaaatctacaactaaatgaattttacgtatatattacccatgtaactactgctcagatgaagatgcagatttacaatattccttccaagtcaatactcccaggtaactgctatcctgatatatattcctacagattagttttgcccacttgtgaatgctatcatatttgtttgtaaatttggttgtacatattatactgtacattcttttgtatctagattctttcactcatgatcatttgtgagatttatccttgttgttgcctgctgctggaatgagttcattctcatttgtatagtattctgttgtatgattacaccacaatttatctttctacttttgatgggcatttatattacttctagtttctggctattggtaaaaaaaaaaaagtacctatgaacattcttgttcatgtattttcatggatacactcatatcttttgaatatatacccaagaatggaaatgctggattatagggtattcatatgtttacctttggttaggtctgccaaacatttttccaaaagggttgtgtcattttacactcccaccatcaatttatgagaattccatttgctccacattcttgtcaacacttggttttgtcagtctttaaatttaagccattctagtcagtgtagagtggtatcttatcatagaaatttgaatttctctggcaagtaataatgggaagtatatctgtttggaggtatttgagaaagggagttgggtacacagtgcagcatgtactgcacttaagacttccaaaaggaggctgcctgatttcttggaggtgaactttctggtgtggccacattctcagtgacttgagatagactagtgttcaaacctaaattgtaaatagatggcttttaatgatctgaacagaactagggttttaattgtaggttgtcaccctgtgattttcttgtataagagatgtaaacttagccaggaactcagagttatttgaatttaaataggataattttcttataatcatgctttattacaaataatcttctaggctgcagtctatacaaccttgccctagtaagcaatatcaaattatgctacatatatgttattggtaaaatccatttgaattgtgattcaaatatggcaatatttttattattactacaagctgttatttggcatgtgataaaacagagttaaactgttggtgaatggcttacacaagttacccaatgacagtatattatctgaattaactttttggattcttagccccgtgcccaaacttactataagaaagtactgatgcagtgttttacatttttttctttcatatctgtaacagatttattttttaaagtaatggattttgagggaaagaaacatgggacagaagtatggaatacaaatatatgtgtgttgctaattatcttataaccacaacaaactaatacagagaatgccctgtacaaaacacaataaagtttcaaagattgaggtgttccttagcaaggctgaaaattttagtctctggtatttgtaatttaggctgcagtcctcatttctggatgagtcactctgtgtgtgtggcacagtctgtgcctttaaccagatttgaacagaagaatgcccatttggcccaggtagaagtagatgaagtgcttggtttcatgtgtcaggcaactaccaaagttcctccccgtgatgcaatgtcgggtgggattgtacttcttgtcaaactgcttctcgatatgggctgaaatagtcttttttatgttctccaatgcctgcgtagctcacaccactaagccctgatgcatctcttccaacgtgactgcattttttatcacagcctttcaatttcacatggttactgtggagcagaggctggtcaactggagtagtctccttggggaggtgctagcatggctcaggccctctggaagctatgttcactactggagccatggtacatctaacacagtttatattcttaatgagactctgtatctagtcgtgttctttctgtgcctaggaaagcatagaaagttcttctcatgctctttccccacctcagttttctcaaggaagcaggacagcacatttgcatataccagcattggaaccattgtaccagtttacttatcttgaacaagtggcttaacctttcagagctccagtttccccagttgtgcaataactactacctcatagtgttggtttgaggatggattagctaatgtttaaaaaacacatagcacaatccttcacatgaagtaatgaaactgaaggtagttatgttaaagttgtcaggcatgagaaaacgagaaaataatcactttctgtcagaggtggacttacactgaagcaaatgcagtttaaattttaatgaagtttaagggccccttgcaagtaagtatactcaaaataagatattttaactacaattggctaggatgactcttctcattttgatttcatctccatcacatttgcctttatttcaaccggtattggagggctgtaggcattcttggctttcagctgtgggaaagttgagtagggaatatgttcagtttgggcttatgagatatgtttgactcacatttctatacataattgggttacttctagctgtcttggtgttggaatggcttctagaaaacctctgactgcccactgtgctatgtgcagatgcaaaggccagagttgtggccaaatggttggacgtgtgcacagtatccagcttcagaagaatgtgggtggtagaaagggaatggtttcatatattccttagatgcacctagtggaaaattcttctgaaccttagagctcacatgtgaaagacacttggatggaagtgtttctaatatttgaccacaatcctgaaactttatgtgaagtcaccaatcatttgttgtgaaaccaaaagatactttattctaaactattgataaaataaattttaacacattgataaatctattttaaactattgataaaataaatttcaaagatgcactgaagtcctattctataatagatattatgaaataattatcatccataaaggtgctcaaagagcatgaagtccaaaacataggaaaaagagacaactagaagtatatcaggacattaattaataaaattatattatttttctggccttttggttgattgtagtatttatcagtttttaatgtatttgttgtgtttttttttctcatccctgatacttttgtagtcagtttggattcacaagtttgcatgttttttttcttttttttttttcttttattattatactttaagttttagggtacatgtgcacattgtgcaggttagttacatatgtatacatgtgccatgctggtgcactgtacccactaactcgtcatctagcattaggtatatctcccaatgctatccctcccccctccccccaccccacaacagtccccagagtgtgatgttccccttcctgtgtccatgtgatctcattgttcaattcccacctatgagtgagaacatgcggtgtttggttttttgtccttgcgatagtttactgagaatgatgatttccaatttcatccatgtccctacaaaggacatgaactcatcattttttatgggtgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttatagtcctttgggtatataaccagtaatgggatgcctgggtcaaatggtatttccagttctagatccctgaggaatcgccacactgacttccacaatggttgaactagtttacagtcccaccaacagtgtaaaagtgttcctatttctccacatcctctccagcacctgttgtttcctgacttttaatgactgccattctaactggtgtgagatggtatctcactgtggttttgatttgcatttctctgatggccagtgatgatgtgagcattttttcatgtgttttttggctgcataaatgtcttcttttgagaagtgtctgttcatgccctttgcccactttttgatggggttgtttgtttttttcttgtaaatttgtttgagttcattgtagattctggatattagccctttgtcagatgagtaggttgcgaaaattttctcccattttgtaggttgccggttcactctgatggtagtttcttttgctgtacagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttgtttctgagggctctgttctgttccattgatctatatctctgttttggtaccagtaccatgctgttttcgttactgtagccttgtagtatagtttgaagtcaggtagtgtgatgcctccagctttgtccttttggcttaggattgacttggcgatgtgggctcttctttggttccacatgaattttaacgtagttttttccaattctgtgaagaaaggcattggtagcttgatggggatggcatggaatctgtaaattaccttgggcagtatggccattttcatgatattgattcttcctacccatgagcatggaatgttcttccatttgtttgtatcctcttttatttccttgagcagtggtttgtatttctccttgagaggtccttcatatcccttgtaagttggattcctaggtattttattcttctttgaagcaattgtgaatgggagttcactcatgatttggctctctgtttgtctgttattggtgtataagaatgcttgtgatttttgtacactgattttgtatcctgagactttgctgaagttgcttatcagcttaaggagattttgggctgaggcaatagggttttctagatatacaatcatgtcgtatgcaaagagggacaatttgacttcctatttccctaattgaataccctttatttccttctcctgcctaattgccctggccagaacttccaacactatgttggatgggagtggtgagagatggcatccctgtcttgtgccagttttcaaagggaatgcttccagtttttgcccattcagtatgatattggctgtgggtttgtcatagatagctcttattattttgaaatacctcccatcagtacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggatttggtaccagaatgatgctggcctcataaaatgagttagggaggattccctctttttctactgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcagtggtgatatcccctttatcattttttattgcgtctatttgattcttctctcttttttttttattagtcttgctagcggtctatctattttgtcgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctccacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcattgatctgtctaatgttgacagtggggtgttaaagtctcccattattaatgtgtgggagtctaagtctctttgtatgtcactcaggacttgctttatgaatctgggtgctcctgtattgggtgcctatatatttaggatagttagctcttcttgttgaattgatccctttaccagtatgtaatggccttctttgtctcttttgatctttgttggtttaaagtctgttttatcagagactaggagtgcaacccctgcctttttttgttttccatttgcttggtagatcttcctccatccttttattttgaacctatgtgtgtctctgcacatgagatgggtttcctgaatacagcacactgatgggtcttgactctttatccaacttgccagtctgtgtcttttaattggagcatttagtccatttacatttaaagttaatattgttatgtgttaatttgatcctatcatgatgatgttagctggttattttgctcgttagttgatgcagtttcttcctagtctcgatggtctttacattttggcatgattttgcagcggctggtaccggttgttcctttccatgtttagtgcttcctttaggaactcttttagggcaggcctggtggtgacaaaatctctcagcatttgcttgtctgtaaagtatttttttctccttcacttatgaagcttagtttggctggatatgaaattctgggttgaaaattcttttctttaagaatgttgaatattgacccccactcttttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcaccttccattgccgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttgtttgcctttggtttgaatgtcctcccgtagctcagagtaatttgatcgtctgaagccttcttctctcagctcgtcaaagtcgttctccctctagctttgttccgttgctggtgaggagctgcgttcctttggaggaggagaggcgctctgctttttagagtttccagtttttctgctctgttttttccccatctttgtggttttatctacttttggtctttgatgatggtgatgtacagatgggtttttggcatggatgtcctttctgtttgttagttttccttctaacagacaggaccctcagctgcatgtctgttggagtaccctgccgtgtgaggtgtcagtgtgcccctgctggggggtgcctcccagttaggctgctcgtgggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttttctgtgccctgcccccagaggtggagcctacagaggcaggcaggcctccttgagctgtggtgggctccaaccagttcgagcttcccggctgctttgtttac

SEQ ID NO: 12782 - DNA, 6543 bp, Homo sapiens
tttttttattttttattttttcttgagttttttttttaatttatttatttattattattatactttaaggtttagggtacatgtgcacaatgtgcaggttagttacatatgtatacatgtgccatgctggtgggctgcacccactaactcgtcatctagcattagttatatctcccaatgctatccctcccccctcccccaaacccaccacagtccccagagtgtgatgttccccttcctgtgtccatgtgttctcattgtttaattcccacctatgagtgagaatatgcggtgtttggttttttgttcttgcgatagtttactgagaatgatgatttccaatttcatccatgtcactacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttaggttatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgttgtttcctgactttttaatgattgccattctaactggtgtgagatagtatctcattgtggttttgatgtgcatttctctgatggccagtgatggtgagcattttttcatgtgttttttggctgcataaatgtcttcttttgagaaatgtctgttcatgtccttcgcccactttttgatggggttgtttggttttttcttgtaaatttgtttgagttcattgtagattctggatattagccctttgtcagatgagtaggttgcgaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgccccatgcctatgtcctgaatggtaatgcctaggttttcttctagggtttttatggttttaggtcgaacgtttaagtctttaatccatcttgaattgatttttgtataaggtgtaaggaagggatccggtttcagctttctacatatggctagccagttttcccagaaccatttattaaatacagaatcctttccccactgcttgtttttctcaggtttgtcaaagatcagatagttgtagatatgcggcgttatttctgagggctctgttctgttccattggtctctatctctgttttggtaccagtaccatgctgttttggtgactgtagccttgtagcatagtttgaagtcaggtagcgtgatgcctccagctttgttcttttggcttaggattgacttggcgatgcgggctcttttttggttccatatgaactttaaagtagttttttccaattgcgtgaagaaagtcattggtagcttgatggggatggcattgaatctgtaaattaccttgggtagtatggccattttcacgatattgattcttcctacccatgagcatggaatgttcttccatttgtttgtatcctcttttatttccttgagaagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggatgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgacgggttgttgaattttgtcaaaggccttttctgcatctattgagataatcatgtggtttttgtctttggttctgtttatatgctggattacatgtattgatttgcatatattgaaccagccttgcgtcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggactccctctttttctattgattggaatagtttcagaaggaatggtaccagttcctccttgtacctctggtagaattcggctgtgaatctatctggtcctggactctttttggttggtaagctattgattattgccacaatttcagatcctgttattggtctattcagagattcaacttcttcctggtttagtctttggagggtgtatgtgtcaaggaatttatccatttcttctagattttctagtttatttgcatagaggtgtttttagtattctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacgtctttatttctgccttcatttcgttatgtacccagtagtcattcaggagcaggttgttcagtttccatgtagttgagtggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgacttgctgtctccttgatctgtctaatgttgacagtggggtgttaaagtctcccattattattgtgtgggagtctaagtctctttgtaggtcactcaggacttgctttatgaatctgggtgttcctgtattgggtgcatatatatttaggatagttagctcttcttgttgaattgatccctttaccattatgtaatggccttctttgtctcttttgatctttgttggttgaaagtctgttttatcagagactaggattgcaacccctgcctttttttgttttccatttgcttggtagattttcctccatccctttattttgagcctatgtgtgtctctgcacgtggatgggtttcctgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagcgcttccttcaggagctcttttagggcaagcctggtggtgacaaaatctctcagcatttgcttgtctgtaaagtattttatttctccttcacttttgaagcttagtttggctggatatgaaattctgggtcgaaaattcttttctttaagaatgttgaatattggcccccactctcttctggcttgtagagtttctgccaagagatctgctgttagtctgatgggcttccctttgagggtaacccgacctttctctctggctgcgcttaacatttttcccttcatttcaactttggtgaatctgacaattatgtgtcttagagttgctcttctcgaggagtatctttgtggcattctctgtatttcctgaatctgaatgttggcctgccttgctagattggggaagttctcctggatgatatcctgcagagtgttttccaacttggttccattctccccgtcagtttcaggtacaccaatcagacgtagatttggtcttttcacatagtcccgtatttcttggaggctttgtttgtttctttttattcttttttctctaaacttcccttcttgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagtaatacattcttcaaaatttttttcaaagttttcaacttctttgcctttggtttgaatgtcctcccgtagcttggagtaatttgatcgtctgaagccttattttctcagctcgtcaaagtcattctccgtccagctttgttctgttgttggtgaggagctgcgtttctttggaggaggagaggcactgcgttcctttggaggaggagaggcgctctgctttttagagtttccaggttttctgctctgttttttccccatctttgcagtttttatctacttttggtctttgatgatggtgatgtacagatgggtttttggtgtggatgtcctttctgtttgttagttttccttctaacagacaggaccttcagctgcaggtctgttgggttacccggccgtgtgaggtgtcagcctgcctctgctagggggtgcctcccagttacctcccagggggtgacctcccagggggtcaggggtcagggacccacttgaggaggcagtctgcccgttctcagatctccagctgtgtgctgggagaaccactgctctcttcaaactgtcagacagggacacttaagtctgcggaggttactgctgtctttttgtgtgtctgtgccctgcccccagaggtggagcctacagaggcaggcaggcttccttgagctgtggtgggctccacccagttggagcttcctggctgctttgtttacctaagcaagcctgggcaatggcgggcacccctcccccagcctcgctgccaccttgcagtttgatctcaggctgctttgctagcaatcagcgagactccgtgggcgtgggaccctccgagccaggtgtgggacacaatctcctggtgcgccgtttttcaagcccgtcggaaaagcgcagcattctggtgggagtgacccaatcttccaggtgccgtctgtcacccctttctttgactaggaaagggaactccctgacccccgtgcttcccaagtgagacaatgcctcgccctgcttcggctcgcggatggagcacgcacccactgacctgcgcccactgtctggcactccctagtgagatgaacccggtacctcagatggaaatggagaaatcgcctgtcttctgcgtctctaacgctgggagctgtataccggagctgttcctattcggccatcttggctcctctctcctctcttcactttaataatggattagttttctgccttctcctgtggggaatccttttggtaagggagggaagaaagattagttattcttgtgcatcggtatctttttctttttttattgtagtaagaacatctaacatgagatctaccctcttaacaattttttaagtgtacaatacagtattgctaactataggcatgaggatgtgcagcagatctctggaacgtttcactcttcataactgaagctttataccccttgaatcgcagtttcccatttccctgtcttcatagcccctggcatccaccattctacactctttctatggggttgactattttaattacctgacacaagtggaatcatgcattatttgtctttctgtgactggtttatttcatgtagcataaagtcatcaaggttcatc

SEQ ID NO: 12783 - DNA, 5707 bp, Homo sapiens
ttttttgtttgtttgtttgtttttgttttttgttttttgttttttttattatactttaagttttagggtacatgtgcacattgtgcaggttagttacatatgtatgtatacatgtgccatgctggtgcgctgcacccactaacttgtcatctagcattaggtatatctcccaatgctatccctcccccctccccccaccccaccacagtccccagagtgtgatattccccttcctgtgtccatgtgatctcattgttcaattcccacctatgagtgagaatatgccatgtttggttttttgttcttgtgatagtttactgagaatgatgatttccaatttcatccatgtccctacaaagaacacgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattccggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtagtgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaggcggcgttatttctgagggctctgttctgttgcattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcgtctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactatcgattattgccacaatttcagctccttttattggtctattcagagattcaacttcttcctggtttagtcttgggagagtgtatgtgtcgaggaatgtatccatttcttctagattttctagtttatttgcgcagaggtgtttgtggtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcgtttaattgtgatgttagggtgtgaattttggatctttcctgctttctcttgtgggcatttagtgctataaatttccctctacacactgttttgaatgtgtcccagagattctggtatgttgtgtctttgttctcgttggttttaaagaacatctttatttctgccttcatttcgttacgtacccagtagtcattcaggagcaggttgttcagtttccatgtagttgagcagctttgagtgagattcttaatcctgagttctagtttgattgcactgtgatctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttataaatcttggtgctcctgtattgggtgcatatatatttaggatagttagctcttcttgttgaattgatccctttaccattatgtaatggccttctttgtctcttttgatctttgttggtttaaagtctgttttatcagatactaggattgcaacccctgcctttttttgttttccatttgcttggtagatcttcctccatccttttattttgaacctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagcctcgatggtctttacattttggcatgattttgcagcagctggtaccggttgttcctttccatgtttagcgcttccttcaggagctcttatagggcagtcctggtggtgacaaaatctgtcagcatttgcttgtctgtaaagtattttatttctccttcacttatgaagcttagtttggctggacatgaaattctgggttgaaaattcttttctttaagaatgttgaatattggccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattgcggaagttctcctggataatatcctgcagagtgttttccaacttggttccattctccccatcactttcaggtacaccaatgagatgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgccttggtttgaatgtcctcccgtagctcagagtaatttgatcgtctgaagccttcttctctcagctcatcaaagtcattctccatccactttgtccgttgctggtgaggaactgcgttcctttggtaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctccagttaggctgctcgggggtcaggggtcaagggacccacttgaggaggcagtctgcccgttctcagatctccagctgtgtgctgggagaaccactgctctcttcaaagctgtcagacagggacacttaagtctgcagaggtttctgctgtctctttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagaaatcagcgagactccgtgggcgtag

SEQ ID NO: 12784 - DNA, 5881 bp, Homo sapiens
acctccccccaccccacaacaggccccagagtgtgatgttccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttagacatttgggttggttccaagtctttgctatcgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacactcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaatattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcgtatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtgaaagatcagatagttgtagatatgcggcgttatttctgagggctctattctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagctttatggggatagcattgaatctataaattaccttgggcagtatggccattttcacaatattgattcttcctacccatgagcatggaatgctcttccatttgtttgtatcctctttgatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagctaaaggagatttggggctgagacaatggggttttctagatatacaatcatgtcatctgcaaacagggacaatttgacttcctcttttcctaactgaatgccctttatttccttctcctgcctaattgccctggccagaacttccaacactatgttgaataggagtggtgagagaggtcatccctgtcttgtgccagttttcaaagggaatgcttccagtttttgcccattcagtatgatattggctgtgggtttctcatagatagctcttattattttgaagtatgtcccatcaatacctaatttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagcattttgatgtgctgctggatttggtttggcagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatctcagatcctgttattggtctattcagagattgaacttcttcctggtttagtcttgggagagtgtatgtgtcaaggaatttacccatttcttctaggttttctagtttatttgcatagaggtgtttgtagtattctctgatggtagtttgtatttctgtgggatcggtggtgatatcccctttatcattttttattgcgtctatttgattcttctctctttttttctttattattcttgctagcggtctatcaattttgttgatcctttcagaaaaccagctcctggattcagtaattttttgaagggttttttgtgtctctatttccttcagttctgctctgattttagttatttcttgccttctgctagcttttgaatgtgtttgctcttgcttttcttgttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttacgtacccagtagtcattcaggaggaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattgggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgagtgcatatatatttaggatagttagctcttcttgttgaattgatccctttaccattatgttatggccttctttgtctcttttgatctttgctggtttaaagtctgttttatcagagactaggatcacaacccctgcctttttttgttttccctttgcttggtagatcttcctccatccttttatttttggcctatgtgtgtctctgcacgtgagattggtatcctgaatacagcacactgatgggtcttgactctttatccaatttgccagtctgtgtcttttaactggagcctttagtccatttacatttaaagttaatcgtgttatgtgtgaatttgatcctgtcattatgatgttagctggttattttgctccttagttgatgcagtttcttcgtagtctcgatggtcattacattttggcatgattttgcagcggctggtaccggttgttcctttccatgtttactgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgactattatgtgtcttggagttgctcttctcaaagagtatctttgtggcattctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatattgcttggaggctttgctcgtttctttttattcttttttctctaaactttccttctcacttcatttcattcatttcatcttccattgctgataccctttcttccagttgatcgcatcggctcctgacgcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcgtcaaagtcattctccgtccagctgtgttccgttgctggtgaggagccgcgttcctttggaggaggagaggcgctctgatttttagagtttccagtttttctgttctgttttttccccatctttgtggttttatctacttttggtctttgatgattgtgatgtacagatgggtttttggtgtggatgtcctttctgtttgttagttttccttctaacagacaggaccctcagctgcaggtctgttggagtaccctgccgtgtgaggtgtcagtgtgcccctgctggagggtgcctcccagttaggctgctcgggggtcaggggtcagggacccacttgagggggcagtctgctggttctcagacctccagctgcatgctgggagaaccactgctctcttcaaagctgtcagacagagacatttaagtctgcagaggttactgctgtctttttgtttgtctgtgccctgcccccagaggtggagcctacagaggcacgcaggcctccttgagctgtggtaggctccacccagttcgagcttccgggctgctttgtttacctaagcaagcctgggcaatggtgggcgcccctcccccagcctcgctgccgccttgcagtttgatctcagactgctgtgctagcaatcagggagactccgtggggtaggaccctctgagccaggtgcaggatataatctcgtggtgtgccgttttttaagcccgtcggaaaagcgcagtattcgggtgggagtgacccgattgtccaggtgccgtccgtcacccctttctttgattaggaaagggaactccctgaccccttgcgcttcccgagtgaggcaatgcctcgccctgctttggctcgcgcacggtgcgcgcacccacttgcctgcgcccactgtctgtcactccctagtgagatgaacccggtacctcaaatggaaatgcagaaatcacctgtcttctgcgtcgctcaggctgggagctgtagacctgagctgttcctattcggccatcttggttcctccccc

SEQ ID NO: 12785 - DNA, 5661 bp, Homo sapiens
gggtatatacccagtaatgggattgttgggtcaaatggtatttctggttctagatctctgaggaatcataaaaggccattctttttttcttttttttttaaattttattattattatactttaagttttagggtacatgtgcacaatgtgcaagtttcttacatatgtatacatgtgccatgctggtgtgctgcacccattaactcatcatttagcattaggtatatctcctaatgctatccctcccccctccccccaccccacaacagtccccagtgtgtgatgttccccttcctgtgtccatgtgttctcactgttcaattcccacctatgagtgagaacatgtggtgtttggtttttggtccttgcaatagtttgctgagaatgatggtttccagtttcatccatgtccctacaaaggacatgaactcatcattttttatggctgcatagtattccatggtgtatatgtgccacattttcttaatacagtctatcgttcttggacatttaggttggttccaagtctttgctattgtgaatagtgccactataaacatacgtgtgcatgtgtctttatagcagcatgatttataatcctttgggtatatagccagtaatgggatgtctgggtcaaatggtatttctagttctagatccctgaggaattgccacactgacttccacaatggttgaactagtttacagtcccaagaacagtgtaaaagtgttcctatttctccacatcctctccagcacctgttgtttcctgactttttaatgattgccattccaactggtgtgagatggtatctcattgtggttttgatttgcatttctctgatggccagtgatgatgagcattttttcatgtgtttttttggctgcataaatgtcttcttttgagaagtgtctgttcatatccttcgcccacttgttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtacagaagctctttagtttcattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtaaaaggtgtaaggaagggatccagtttcagctttccacatatggctagccagttttcccagcaccatttattaaatagggaatcctttccccattgcttgtttttctcaggtttgtcaaagatcagatagttgtagatatgcggcattatttctgagggctctgctctgttccattgatctatatctctgttttggtacccgtaccatgctgctttggttactgtagccttgtagtatagtttgaagtcaggtagcgtgatgcctccagctttgttcttttggcttaggattgactcggcgatgcaggctctttttctggttccatataaactttaaagtagttttttccaattctgtgaagaaagtcattggttgcttgatggggatggcattgaatctataaattaccttgggcagtatggccattttcacgatattgattcttcctacccatgagcatggaatgttcttccatttgtttgtatcttcttttatttcattgagcagtggtttgtagttctccttgaagaggcccttcacatcccttgtaagttggattcctaggtattttattctctttgaagcaattgtgaatgggagttcactcatgatttggctttctgtttgtctgttactggtgtaaaagaatgcttgtgatttttgcacatcgattttgtatcctgagactttgctgaagttgcttatcagcttaaggagattttgggctgagatgatggggttttctagatagacaatcatgttgtctgcaaacagggacaatttgacttcctcttttcctaattgaataccctttatttccttctcctgcctgattgccctggccagaacttccaacactatgttgaataggagtcgtgagagagggcatccctgtcttgtgcctgttttcaaagggaatgcttccagtttttgcccattcagtatgatattggctgtgggttgtcatagatagctcttattattttgagatacgtcccatcaacacctaatttatagagagtttttggcatgaagggctgctgaattttgtcaaaggccttttctgcatctattgagataatcatgtggtttttgtctttggttctgtttatgttggattacatttattgatttgtgtatgttgaaccagccttgcatcccagggatgaagcccacttgatcatagtggataagctttttgacgtgctgctggatttggtttgccagtattttattgaggatttttgcatcgatgttcatcaaggatattggtctaaaattctctttttttggttgtgtctctgccaggctttggtatcaggatgatgctggcctcataaaaagagttagggaggataccctctttttctactgattggaatagtttcagaaggaatggtaccagctcctccttgtacctacctctggtagaatttggctgtgaatccatctggtcctggactttttttggttagtaagctattgattattgcctcaatttcagagcctgttattggtctattcagagattcaacttcttcctggtttagtcttgggaggatgtatgtgtcaaggaatttatccgtttcttctagattttctagtttatttgcgtagaggtgtttatagtatctctgatggtagtttgtatttctgtgggatcggtggtgatatcccctttatcattttttattgcgcctatttgattcttcttttcttctttactagtcttgctagcggtctgtcaattttgttgatcttttcaaaaaaccaggtcctggattcattaattttttgaagggtttttttggtctctatttcctccagttctgctctgatcttagttatttcttgccttctgctagcttttgaatgtgtttgctcttgcttttctagttcttttaattgtgacgttagggtgtcaattttagatctttcctgctttctcttgtggacatttagtgctataaatttccctgtacacactgctttgaatgtgtcccagagattctggtatgttgtgtctttgttctccttggtttcaaggaacatctttatttctgccttcatttcattatttacccagtagtcattcaggagcaggttgttcagtttccatgtagttgagtgtttttgagtgagtctcttaatcctgagtcctagtttgattgcactgtggtctgagagacagtttgttataatttctgttcttttacatttgttgaggagtgctttacttccaactatgtagtcaattttggagtaggtgtggtgtggtgctgcaaagaatgtatattctgttgatttggggtggagagttctgtagatgtctattaggtccacttggtgcagagctgagttcaattcctgggtatccttgttaactttctgtgtcattgatctgtctaatgttgacagtgaggtgttaaagtctcccattattattgtgtgggagtctaagtcactttgtaggtcactaaggacttgctttatgaatctgggtgctcctgtattgggtgcatatatatttaggatagttaactcttcttgttgaattgatccctttaccattatgtaatggccttctttgtctcttttgatctttgttggtttaaagtttgttttatcagagactaggattgcaacccctgcctttttttgttttccatttgcttggtagatcttcctccatccctttattttgagcctatgtatgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagatggttattttgcttgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttacttgtctgtaaagtattttatttctccttcacttatgaagcttagtttggctggatatgatattctgggttgaaaattcttttctttaagaatgttgaatattggcccccactctcttctggcttgtagaatttctgccaagagatccgctgttagtctgatgggcttccctttgtgggtaacccgacctttctctctggctgcccttaacattttttccttcatttcaactttggtgaatctgacaattatgtgtcttggagttgctctctcgaggagtatctttgtcgcgtcctctgtatttcctgaatttgaatgttggcctgccttgctagattggggaagttttcctatatcctgcagagtgttttccaacttggttccattctccccgtcactttcacgtacaccaatcagatgtagatttggtcttttcacatagtcccatatttcttggaggttttgttcacttctttttattctttttgctctaaacttctcttctcgcttcacttcattcatttcgtcttccatcactgataccctttctgccagttgatcacatcggctactgaggcttctgcattcgtcacgtagctctcgtgccttggttttcagctccatcaggtcctttaaggacttctctgcattggttattctagttatccattcatctaattttttttcaaagcttttaacttctttgccattggtttgaacttcctcctgtagctcagagtagtttgatcatctgaagccttcttctctcaactcgtcagtcattctttgtccagctttgttccgttgctggtgaggagctgcgttcctttggaggaggagaggcactctgatttttagagtttccagtttttctgctgtttttttcccatctttgtggttttatctacctttggactttgatgatggtgacgtacagatgggtttttggtgtggatgtcctttctgtttgctagttttccttctaacagacaggaccctcagctgcaggtctgttggagtttgctggaggtccactccagaccctgtttgcctgggtatcagcagcagtggctgcagaacagcggatattggtgaaccgcagatgctgctgcctgatcgttcttctggaagttttgtctcagaggagtacctggccatgtgaggtgtcagtccacccctactggggggtgcctcccagttaggctactcgggggtcagggacccacttgaggaggcagtctgcccgttctcagatctcaagctgcatgctgggagaaccactactctcttcaaagctgtcagagagggacatttaagtctgcagaggttactgctgtcttt

SEQ ID NO: 12786 - DNA, 7380 bp, Homo sapiens
tttttgtattttaagtagagacagggtttcaccatgttatccaggctggtctcaaactcctgacctcgtgatccacccacctcggcctcccaaagtgctgggattacaggcgtgagccaccgcgcccggccagacacagttttcttcatgtgaggtagaaataacacatgcctttaaggactgcagaatgatgagtggtgatgttcttgaactcttccaatactccacatatatacattatttctatccctggaaaatttgcattaatgaaataaagcattcttagtataataagtctgagcagatgagaatttaagtgaaggttctatacacacctgatgcacgacaggcagacccccaaattgaggcttagcccgagagggttcttagcttcacccacgaaacaatttcaaaggcaagccagtggtgttaaacaacgacttttattgaagcagtagcctacagcagccgcagaggtactgcttcttgcagagcagggctaccccctaggcagcgtgcccagcttaggtagcttagagggagttctgcagtcatacttagacccacttttaattatatgcaaattaaggggcaacttatgcagaaatttctaggatgaaggttgtaacttccgggttgtccaggttgttgccgtgaaaaagggcagtaatttatgggtattgccatggcaatgataaaccaagatggcacattggtgggagtgtcttatgcggaggtgtttccaccctgacctgtttgagctagtccatcatttggtcaggtatccaagcccgacccccaaagcctagtcctgcctcctaccacacacccagaaatatggatttattcccatgtccggtgcaaatgtaggaaaagcattattttcttattataagggaggtattatgaagaccaaccaacttaaagagtttctgtgttggaaattgagagacctcatttccttctgtgtttaccccacaaatgcccgcaggggctctgaagttttgtagcagcaacctcatcttacatccttgtcattacaagtaaacagtgccacacaattaataactaataatagttacaagaaatatcacttattgaaggtctccagtctattaagtattttataattattaacatattgatggatgctatattttgttttcaagttagtttgagtttcttttcagctttactgacatataattgacagttaaaatttgtatatattcaacatgtaccacaagatgatttgatatatgtatacattgtggaatgtttaccacaatctaaataattagcacatctattgccacacatagttaccattgtgtgtgtgtgtgggtgtgtgtgtgtgtatggtgaggacactaagattttctctcttggcaaatttcaagtaaccagtgctgtattattaactatagtcaccatgttgtacattcgatctgaagggtactacattgttatggttaagagtgtagtcccgcatgttgtcaccataagtgggagctgaacaatgataacacatggacacagggaggggagcatcacacacccacacaccggggcctgtttgggagtgaggggctggggtagggatagcgttaggagaaatacctaatgtaaatgatgagttgatgggtgtagcaaactaacatggcacatgtatacctatgtaacaaacttgcatattgtgcacatgtaccttagaacttaaagtataataatagtaaaagaaaacagtatagtttctcaagctcaataattctgggttggaatctcacttccattatgtcttaattgagtgacttctggtccattgtttatgcttcatattcctcatgattttttttctgtaaaaaaatactaatgaattattgtctgatatatagaatatttgttgaatgaacacctgcttaggcgagatggtaaatgtgatgtttagcactgtgttacatatatcattactctgttaattcttgcagtaatttaactggtcagtaacaataataataataataataataataaacagtttaataaaatgcttaggatgtcctaagcactttgtatatataattcatttaatctatactacactattttatatagatattatcttccaagtttttttttcagaggacattgaggatcagcaagattgagtactttgcttaacccgtgaactcaggtcagaattactccaaacataatttttaactacaaaatgtctatcattctacctctgaatttgttgttgtttttaacttccatacatctgatttgaaattcctttatatatttggggaccttttcactttatgagtcttgttgagggacagtgcctttctcccactgtttaaactgaaaataccagacacatttacatgtaaacaatgtgaaggaaagttgactctctttatttttttttttagaagtaaagtttaaagtctttttattttattttattattattatgctttaagttttagggtacatgtgcacaatgtgcaggttagtcacatatgtatacatgtgccatgctggtgtgctgcacccattaacttgtcatttagcattaggtatatctcctaatgctatccctccccccttcccccaccccacaacagtccacagagtgtgatgttccccttcctgtgtccatgtgttctcattgttcaattcccacctatgagtgagaatatgcagtgcttggttttttgttcttgcgatagtttactgagaatgatgatttccaatttcatccatgtccctacaaaggacatgaactcatcattttttatggctgcatagtattccatggtgtatatatgccacattttcttaatccagtctatcattgctggacatttgggttggttccaagtctttgctattgtgaagagtgctgcaataaacatacgtgtgcatgtgtttttatagcagcaggatttatagtcctttgggtatataccccgtactgggatggctgggtcaaatggtatttctagttctagatccttgaggaatggccacactgtcttccacaatggttgaactaatttatacttgcgccaacaatgtaaaagcattcctatttctccacatcctctccagcacctgttgtttcctgactttttaatgattgccattctaactggtgtgagatagtatctcattgtggttttggtttgcatttctcttatggccagtgatggtgagcattttttcatgtgttttttggctgcataaatgtcttctgttgagaagtgtctgttcatgtcccttgcccacttttggatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgacctgaatggtaatgcttaggttttcttctagggtttttatggttttatgtctaacgtttaagtctttaatccatcttgaattaatttttgtataaggtgtaaggaagggatccagtttcagctttctacatatggctggccagttttcccagcaccatttattaaatagggaatcctttccccattgcttgtttttctcaggtttgtcaaagatcagatagctatagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctgttttttggttccatatgaactttaaagtagttttttccaattctgtgaagaaaatcattggtagcttgatggggatggcattgaatctataaattaccttgggcagtacggccattttcatgatattgattcttcctacccatgagcatggaatgttcttctatttgtttgtatcctctttatttcattgagcagtggtttgtagttctccttgaagaggtccttcacatcccttgtaagttggattcctaggtattttattctctttgaagcaattgtgaatgggagttcactcatgatttggctctctgtttgtctgttatttgtgtataagaatgcttgtgatttttgtacattgattttgtatcctgagactttgctgaagttgcttgtcagcttaaggagattttgggctgagacaatggggttttctagatatacaatcatgtcacctgcaaacagggacaatttgacttcctcttttcctaattgaatgccctttatttccttctcctgcctgattgacctggccagaacttccaacactatattgaataggagtgatgagagagggcatccctttcttgtgccagttttcaaagggaatgcttccagttttcgtccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggttctgtttatatgctggattacatttattgatttgcatatattgaaccagccttgcatcccagggatgaagcccacttaatcatcgtggataacctttttgatgtgctgctggatttggtttgccagtattttattgaggatttttgcatcaatgttcatcaaggatattggtctaaaattctcttttttggttgtgtctctgcctggctttggtatcagaatgatgctggcctcagcaaatgagttagggaggattccctctttttctattgattggaatagtttcagaaggaatggtaccagttcctccttgtacttctggtagaattcggctgtgaatccatctggtcctggactctttttggttggtaagctattaattattgccacaatttcagagcctgttattggtttattcagagattcaacttcttcctggtttagtcttgggagggtgtacgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctcttttttctttattagtcttggtagcggtctatcaattttgttgatcctttcaaaaaaccagctcctagattcattaattttttgaagggttttttgtgtctctatttccttcagttctgctctgattttagttattccttgccttctgctagcttttgaatgtgtttgctcttgcttttctagttcttgtaattgtgatgttagggtgtcaattttggatctttcgtgctttctcttgagggcatttaatgctataaatttctctctacacactgctttgaatgtgtcccagagattctggtatgttgtgtctttgttctcgttggtttcaaagatcatctttatttctgtcttcattccgttatgtagccagtagtcatttagtagcaggttgttcagtttgcatgtagttgagcggttttgagtgagtttcttaatcctgagttctagtttgattgcactgtggtctgagagacagtttgttgtaatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgtagagctgagttcaattcctgggtatccttgttaaatttctgtctcgttgatctgtctaatgttgacagtggggtgttaaagtctcccattattattgtgtgggagtctaagtgtctttgtaggtcactcaggacttgctttatgaacctgggtgctcctgtattgggtgtatatatatttaggatagttagctcttcttattgaattgatccctttaccattatgtaatggccttctttgtgtcttttgatctttgttggtttaaagtctgttttatcagaggctaggattgcaacccctgccattttttgttttccatttgcttggtagatcttcctccatccttttattttgagcctatatgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatattagctggttattttgctcattagttgatgcagtttcttcctggcctcgatggtctttacaatttggcatgattttgcagtggctggtaccggttgttgctttccgcgtttagtgcttccttcaggagctcttttagagcaggcctggtggtaacaaaatctctcagcatttgcttgtctgtaaagtattttatttctccttcacttatgaggcttagtttggctggatatgaaaatctgggttgaaaattcttttctttaggaatgttgaatattggcccccactctcttctggcttgtagagtttctgccgagagatccactgttagtctgatgggcttccctttgtgggtaacccgacctttctctctggctgcccttaacattttttccttcatttcaactttggcaaatctgacaattatgtgtgttggagttgctcttctcgaggagtatctttgtggcgttctctgtatttcctgaatctgaatgttggcctgccttgctagattggggaagttctcctttataatatcctgcagagtgttttccaacttggttctattctccccgtcactttcaggtaggccaatcagacatagatttggtcttttcacatagtcccatatttcttggatgctttgttcatttctttttattcttttttctgtaaacttcccttctcgcttcatttcattcatttcatcttccatcactgataccctttcttccagttggttgcatcggctcctgaggcttctgcattcttcacgtagttctcgagccttggctttcagctccatcagctcctttaagcacttctctgtattggttattctagttatacattcgtctaaatttttttc

SEQ ID NO: 12787 - DNA, 4928 bp, Homo sapiens
ttatttattttttataattatactttaagttctagggtacatatgcatagcgtgcaggtttgttgcatatgtatacatgtgccatgctggtgtgctgcactagttaactcatcatttacattaggtatatctcctaatgctatccctcccccgtacccccaccccaagacaggccccagtgtgtgatatttcccaccctgtgtccaagtgttctcattgttcaattcccaccaagaatgagaacatgacgtgtttgattttctgtccttgcaatagtttgctcagaatgatggtttccagcttcatccatgtccctacaaaggacatgaactcatcattttttatggctgcatagtattccatggtgtatatgtgccatattttcttaatccagtctatcattgatggacatttgggttggttccaagtctttgctagtgtgaatagtgccgcaataaacatacgtttgcatgtgtctttatagcagcatgatttataatcctttgggtatatacccagtaatgggatggctgggtcaaatggtatttctagttctagattgttgaggaatcaacacactgtcttccataatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctggataaatgtcttcttttgagaagtgtctgttcatatccttcatccactttttgatggggttgtttgatttttttcttgtaaatttgtttaagttctttgtagattctggatattagccctttgtcagatgggtggattgcaaaaattttctcccattctgtaggttgcctgttcactctgatggtagtttcttctgccatgcagaagctcttgagttgaattagatcccatttgtcaattttggcttttgttgccattgcttttggtgttttagtcatgaagtcctttcccgtgcctatgtcctgaatggtactgcctaggttttcttctagggtttttattgttttaggtctaacatttaagtctttaatccatcttgaattaatttttgtataaggtgtaaggaagggatccagtttcagctttctacatatggctagccagttttcccagcaccatttattaaatagggaatcctttccccatttcttatttttgtcaggttcgccaaagatcagatggttgtagatgtatggtgttatttctgagggctctgttctgttccattgatctacatctctgttttggcaccagtaccatgctgttttggttactgtagccttgaggtacagtttgacgtcagggagtaatgcctccggctttgttcttttggcttaggattgtcttggcaatacgggctcttttttggttccatataaactttaaagtagtttttccaattctgtgaagaaagtcattggtagcttgatggggatggcattgtgtctataattaccttgggcagtattgccattttcatgatattgattcttcctatccatcagcatggaatgttcttccatttgtttgtgtcctcctttatttcgttaggcagtggtttgtagttctccttgaagaggtccttcccatctcttgtaagttggattcctaggtattttattctctttgaagcaattgtgaatgggagttcactcatgatttggctctctgtttgtctgttattggtgtataggaatgcttgtgatttttgtacattgattttgtatcttgagactttgctgaaggtgcttatcagcttaaggagattttgggctgagacaatggggttttctaaatatacaatcatatcatctgcaaacagggacaatttgacttcctcttttcctaattgaatatcctttatttatttctcctgactgattgccctggccagaacttccaacactatgttgaataggagtggtgagagagggcatccctgtcttctgccagttttcaaagggaatgctcccagtttttgcccattcagtatgatattggctgtgggtttgtcataaatagctcttgttattttgagatacatcccatcaatacctaatttattgagagtttttagcatgaagggctgttgaactttgttgaaggccttttctgcatctattgagataatcatgtggtttttgtctttggttctgtttatacgatggattacatttattgatttgcatatgttgaaccagccttgcatcctaggaatgaagctcacttgatcacggtggataagctttttgatgtgctgatggatttgggttgcagtattttattgaggatttttgcattgatgttcatcagggatattggtctaaaattctctttttttttgttgtatctctgccaggctttggtatcaggatggtgctggcctcataaaatgagttagggaggattccctctttttctattgattggaatattttcagaaggaatggtaccagctcctccttgtacctctggtagaattctgctgtgaatccgtctggtcctggactttttttggttggtagtctattaattattgcctcaatttcagagcctgttattgatctattcagggattcaacttcttcctggtttagtcttgggagggtgtatgtgtccacgaatttatccatttcttctagattttcaagtttatttgcatagaggtgtttatagtattctctgatggtagtttgtatttctatgggattggtggtgatatcccctttatcattttttattgcatctatttgattgttctctcttttcttctttattagtcttgctagtggtctatcaattttgtagatcttttcaaaaaaaccagctccaggattcattgatttttttgaaggggtttttttgtgtctctgtcttcttcagttctgctctgatcttagttattccttgctttctgctagcttttgtgttttctcttgcttctctagttcttttaattgtgatgttagggtgtcaattttagatctttcctgctttctcttgtgggcatttagtgctataattttccctctacacactgctttaaatgtgtcccagagattctggtatgttgtgtgtttgttctcattggtttcaaagaacatctttatttctgccttcatttcgttatgtacccagtagtcattctggagcaggttgttcagtttccatgtagttcagcggttttgagtgagtttctcaatcctgagttctagtttgattgtactgtggtctgagagacagtttgttataatttctgttcttttacatttgctgaggagagctttacttccaactatgtggtcaattttggaataagggcgatgtggtgctgagaagaatgtatattctgttgatttggggtggagagttctgtagatgtcccttaggtccacttggtacagagctgagttcaattcctggatagcctttttaattttctgtctcattgatctgtctaatgttgacagtggggtgttaaagtctcccatgattactgtgtgggagtctaagtctctttgtaggtgtctaaggacttgctttatgaatctgggtgctcctgtattgggtgcatatatatttaggatagttagctcttcttgttgaattgatccctttactattatgtaatggccttctttgtctcttttgatctttgttggtttaaagtctgttttatcagagactaggattgcaacctctgctttttttgctttccatttgcttggtagatcttcctccatccctttattttgagcctatgtgtgtgtctctgcacgtgggctgggtctcctgaatacagcacactgatgggtcttgactctttatccaatttgccagtctgtgtcttttaattggagcatttagcccatttacatttaaggttgatattgttatgtgtgaatttgatcctgtcattatgatgtgagctggttattttgctcattagttgatgcagtttcttcctagcctggatggtctttacaatttggcatggttttgcagtggctggaactcgtttttcctttccatgtttagtgcttccttcaggagctcttgtaaggcaggcctggtggcgacaaaatctctcagcatttgcttgtctgtaaaggcttttatttctccttcacttatgagcttagtttggctggatgtgaaattctgggttgaaaattctttctttaagaatgttgaatattggcccccactctcttctggcttgtagagtttctgtcgagagagccgctgttagtctgatgggcttgccattgtggtttacctgacgtttctctctggctgcctttaacatttttcccttcatttcaactttggtgaatctgacaactatgtgtcttggagttgttcttctcgaggagtatctttgtggcgttcactgtatttcctgaatttgaatgttggcctgccttgctaggttggggaaattctcctggttaatatcctgaagagtgttttccaacttggttccattctccccgtcactttcaggtacaccaatcagatgtagatttggtcttttcacatagtcccatatttcttggagactttgttcatttctttttactcttttttctctaaacttctcttcttgcttcatttcattcatttgatattcaatcactgataccctttcttccacttgattgaattggttactgaagcttgtgcatgtgtcacatattgctcttgccatggttttcagctccatcaggtcatttaaggtcttctctacactgtttattctggtcagccattcatctaatcttttttcaaggtttttag

SEQ ID NO: 12788 - DNA, 6129 bp, Homo sapiens
ttttttctttttttttttttttattatactttaagttttagggtacatgtgcacattgtgcaggttagttacatatgtatacatgtgccgtgctggtgcgctgcacccattaactcgtcatctagcattaggtatatctcccaatgctatccctcccccctccccccaccccacaacagtccccagagtgtgatgttccccttcctgtgtccatgtgatctcattgttcaattcccacctatgagtgacaatatgcggtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgattcatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacccgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtgggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgacgcgggctcttttttggttccataatgaactttaaagtagttttttccaattctgtgaagaaagtcattggtagcttgatggagatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgtggtttttgtcttttgctctgtttatatgctggattacatttattgatttgcgtatatggaaccagccttgcatcccagggatgaagcccacttgatcatagtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagatgcaacttcttcctggtttagtcttgggagagtgtatgtgtcgaggaatttatccatttcttctagattttccagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcatgtctttgttctcgttggtttcaaagaacatcttcatttctgccttcattttgttatgtacccaatagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactgtgtggtcaattttggaacaggtgtggtgtggtgctgaaaaaaatgtatattctgttgatttggggtggagagttctgtagatgtctattaggtccgcttggtgcagagctgaattcaattcctgggtatccttgttgactttgtgtctcgttgatctgtctaatgttgacagtggggtgttaaagtctcccattattaatgtgtgggagtctaagtctctttgtaggtcactcaggacttgctttatgaagctgggtgctcctgtattgggtgcatatatatttaggatagttagcccttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttcgtccatttacatttaaagttaatattgttatgtgtgaatttgatcctgtcattatgatgttagctggtgattttgctcgttagttgacgcagtttcttcctagtctcgatggtctttacattttggcatgatttttcagcagctggtactggttgttcctttccatgtttagcgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcctttcaactttggtaaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctcctcattactttcaggtacaccaatcagacgcagatttggtcttttcacatagtcccatatttcttggaggctttgctcatttctttttaatcttttttctctaaacttcccttctcacttcatttcattcatttcatcttcccttgctgataccctttcttccagttgattgcatcggctcctgaggcttctgcattcttcacgtagttctcgagccttggttttcagctccatcagctcctttaagcacttctctgtattggttattctagttatacattcttctaaattttcttcaaagttttcaacttctttgcctttggtttgaatgtcctcccatagctcagagtaattggatcgtctgaagccttcttctctcagctcgtcaaagtcattctccatccagctttgttccattgctggtgaggaactgcgttcctttggaggacgagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcaactgcaggtctgttgaaataccctgccttgtgaggtgtcagtgtgcccctgctgggaggtgcctcccagttaggctgctcgggggtcaggggtcagggacccacttgaggaggcagtctgccggttctcagatctccagctgcgtgctgggagaaccactgctctcttcaaagctgtcagacagggtcatttaagtctgcagaggttactgctgtctttttgtttgtctgtgccctgcccccagaggtggagcctacagtggcaggcaggcctccttgaactgtggtgggctccacccagttcgagcttcccggctgctttgtttacctaagcaagcctgggcaatggcgggcgcccctcccccagactcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgccccgattttccaggtgcgtccgtcacccctttctttgactcggaaagggaactccctgaccccttgcgcttcccaggtgaggcaatgcctcgccctgcttcggctcgcgcagggtgcgcgcacacactggcctgcgcccactgtctggcactccctagtgagatgaacccggtacctcagatggaaatgcagaaatcacccgtcttctgcgtcgctcacgctgggagctgtagaccggagctgtagaccagagctgttcctattcggccatcttggctcctcccaaatctccttttttcttatcttaatggggaaaattgcattttatatattaaacaataacatgtgtcttagataaa

SEQ ID NO: 12789 - DNA, 5391 bp, Homo sapiens
tttttttttcttttttttaaattttattattattatacttttagggtacatgtgcacaatgtgcagatttgttacatatgtatacatgtgccatgttggtatgctgcacccattaactcgtcatttagcattaggtatatctcctaatgctatccctccccccgccccccaccccataacagtccccggagtgtgatgttccccttcctgtgtccatatgttctcattgttcaattcccacacctatgagtgagaacatgtggtgtttggttttttgtctttgcgatagtttgctgagaatgatggtttccagtttcatccatgtccctacaaaggacatgaactcttcattttttatggctgcagtattccatggtgtatatgtgccacattttcttaatccagtctatcgttattggacatttgggttggttccaagtctttgctgttgtgaatagtgccgcaataaatatatgtgtgcatctgtctttatagcagcatgatttataatcctttgggtatatacccagtaatgggatggctgggtcaaatggtatttctagttctagatccctgaggaatctccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcattttctcatgtgttttttggctgcataaatgtcttcttttgacaggtgtctgttcacatccttcgcccactttttgatggggttggtttttttttcttgtaaatttgtttgagttcattgtagattctggatattagccctttgtcagatgagtaggttgcaaaaattttctcccattttgtaggttgcctgttcactctgatggtagtttcttttgctgtgcagaggctctttagtttaattagatcccatttgccaattttggcttttgttgccattgcttttgctgttttagacatgaagtccttccccatgcctatgtcatgaatgatattgcctaggttttcttctagggtttttatggttttaggtctaacatttaagtctttaatccatcttgaattaatttttgtataaggtgtaaggaagggatccagtttcagctttctacatatggctagccagttttccaagcaccatttgttaaatagggaatccttttcccattgcttgtttttgtcaggtttgtcaaatatcagatggttgtagatatgcggcattatttctgagggctctgttctgttccattgatctatatctctgttttggtaccagtaccatgctgttttggttactgtggccttgtagtgtagtttgaagtcaggtagcgtgatgcctccggctttgttcttttggcttaggattgacttggcgatgcgggctctttttggttccatatgaactttaaagtagttctttccaattctgtgaagaaagtcattggtagcttgatggggatggcactgaatctataaattaccttgggcagtatggccattttcacaatattgattcttcctacccgtgagcatggaatgttcttccatttctttgtatcctctttaatttcattgagcagtggtttgtagttctccttgaagaggtccttcacatcccttgtaagttggattcctaggtattttattctctttgaagcaattgtgaatgggggcgttcactcatgatttggctctctggttgtctgttattggtgtgtaagaatgcttgtgatttttgtacattgattttgtatcctgagactttgctgaagttgcttatcagcttaaggatatttggggctgagacaatggggttttctagatatacaaccttgtcatctgcaaaccaggacaatttgacttcctcttttcccaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcttagatagctcttattattttgagatacgtcccatcaatacctaatttattgagaggttttagcacgaaggttgctgaattttgtcaaaggccttttctgcatctattgagataatcatgtggtttttgtctttggttctgtttatatgctggattacatttattgatttgcgtatgttgaaccagccttgcattccagggatgaagcccacttgatcatggtggataagctttttgatgtgctgctggattcgctttgcaagtattttattgagcatttttgcatcaatgttcatcaaggatattggtctaaaattctctttttttgttgttgtatctctgcccggctttggtatcaggatgatgctggccttatcaaatgagttagggaggattccctctttttctattgattggagtagtttcagaaggaatggtaccagttcctccttgtacctctggtagaattcggctgtgaatccatctggtcgttgactttttttgttagtaagctattgattattgccacaatttcagagcctgttattgttctattcagagattcaacttcttcctggtttagtcttgggagggtgtatgtgtccaggaatttatccatttcttctagattttctagtttatttgcgtagaggtgtttgtagtattctctgatggtagtttgtatttctgtgggatcggtggtgacatcccctttatcattttttactgtgtctatctgattcttctctcttttcttctttattagtcttgctagcggtctatcaattttgttgatcttttcaaaaaaacagctcctggattcattaatttttgaagggttttttgtgtctctatttccttcagttctgccctgatgttagttatatcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagtttccacgtagttgagcggttttgagtgagtttcttaatcctgagttctagtttgattgcactgtggtctgagagacagtttgttataatttctgttcttttacatttgctgaggagtgctttacttccaaccatgtggtcaattttggaataggtttggtgtggtgctgaaaaaaatgtatattctgttgatttggggtggagagttctgtagatgtctattaggtccgcttggtgcagagctgagttgaattcctggatatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatcccttcaccactatgtaatggtcttctttgtctcttttgatttttgttggtttaaagtctgttttatcagagactaggattgcaacccctgccttcttttgttttccgtttgcttggtagatattcctccatccctttattttgagcctatgtgtgcctctgcacgtgagatgggtttcctgtatacagcacactgatgtgtcttgactctttatccaattttccagtttgtgtcttttaattggaggatttagcccatttacatttaaggttaatattgttatgtgtgaatttgatcctgtcattatgatgttagctggttattttgctcggtagttgatgcagtttcttcctagccttgatggtctttacattttggcgtgtttttgcagtggctggtaccggttgttcctatccatgtttagtgcttccttgaggagctcttttagggcaggcctggtggtgacaaaatctctcagcatttgcttgtctgtaaagtattttatttctccttcacttatgaagcttagtttggctggatatgaaattctaggttgaaaattgttttctttatgaatgttgaatgttggcccccactctcttctggcttgtagagtttctgcagagagatctgctgtaagtctgatggacttccctttgtgggtaacctgatctttctctctggctgcccttaacattttttccttcatttcaactttggtgaatctgacagttatgtgtcttggagttgctcttctcgaggagtatctttgtagcattctctgtatttcttgaatctgaatgttggcctgccttgctaggttggggaagttctcctggataatatcctgcagagtgttttccaacttggttccattctccccgtcactttcaggtacaccaatcaaatgtagatttggtcttttcacatagtcccatatttcttggagtctttgttcatttctttttattattctttctctaaacttcccttcttgcttcatttcattcatttagtcttccatcactgataccctttcttccagctgatcgcatcggctcctgaggcttctacattcttcacgtagttctcaagccttggctttcagctccatcagctcctttaaggacttctctgcattggttattctagttatccaatcatctaattttttttcaatgtttttaacttctttgccattggtttgaatttcctcctgtagcttggagtagtttgatcgtctgaagccttcttctctcaacttgtcattctccatccagctttgttccattgctggtgaggagctgcattccttcggaggaggagaggcactgtgctttttagagtttccagtttttcttctctgttttttccccatctttgtggttttatctacttttggtctttgatgatggtgatgtacagatgggtttttggtgtggatgtcctttctgtttgttagttttccttctaccagacaggaccctcagctgcaggtctgttggagtttgctagaggtccactccagaccctgtttgcctgggtatcagcagtggtggctgcagaacagcggtggttgtagaacagcggatattggtgaaccgcaaatgctgctgcctgatcattcctctggaagt

SEQ ID NO: 12790 - DNA, 20704 bp, Homo sapiens
gtttttttttattatactttaagttttagggtacatgtgcacaacgtgcaggtttgttacatatgtatacatgtgccatgttggtgtgctgcacccttaaatcgtcatttacattaggtatatctcctaatgctatccctcccccctcccccaaccccacaacaggccccggggtgtgatgttccccttcctgtgtccaagtgttctcattgttcagttcccacctatgagtaagaacatgcagtgtttggttttttgtccttgcgatagtttgctgagaatgatggtttccagcttcatccatgtccctacaaaggacatgaactcatcattttttatggctgcatggtattccatggtgtataagtttttttttttttaattttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattcgccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacacctatgtcctgagtggtaatgcctaggttttcttctagggtatttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttagagtagttttttccaattctgtgaagaaagtcattggtagcttgatggggatggcattgaatctgtaaattaccttgggcagtatggccattttcacgatattgattcttcccacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgttgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaatagtagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtgtttggctctgtttatatgctggattacatttattgatttgcgtatattgaaccagccttgcatcccagggatgaagcacacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacacctttatttctgccttcatttcgttatgtacccagtagtcattcaggagcaggttgttcagtttccatgtagttgagcagctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgcgtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatgtccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgctgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtacccgttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaacgttgaatattggcccccactctcttctggcttgtaaggtttctgccgagagatccgctgttagtctgatgggctttcctttgagggtaacccgaccattctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatgtggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggtgttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgtgtttttgagtttccagtttttctgttctgtttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtctcgtggtgcgccgtttcttaagctggtctgaaaagcgcaatattcgggtgggagtgacccgattttccaggtgcttccgtcacccctttctttgactcggaaagggaactccctgaccccttgcgcttcccaggtgaggcaatgcctcgccctgcttcggctcgcgcacggtgcgcgcacacactggcctgcgcccactgtctagcactccctagtgagatgaacccggtacctcagatggaaatgcagaaatcacccgtcttctgcgtcgctcacgctgggagctgtagaccggagctgttcctattcggccatcttggctcctagtatttttaattaaggtatgtacattgctttcttggacatattgctattgcacatctaattgatgacaatatagtgtaaacataacttttgtgtgcactgggaaaccaaaaaatgtttgtgacttactttattgtggtggtatgaaaccaaaaccacaatatttccaaggcatgccagtacaactttaaaaagttagcaaaatatcctacctttttttatggacatcataaatcagagtaatattttgttgacctgttgaaagaagcctctcatctggccttccataattattctgtctctagttttgttttcttctttatttggctaactatataattaggacagcattctctggaattgccaatcttagtttgattatgtgacctttgagccatgtttactgggttttggagaagactgtcatctgtacttagagatttgaacctcatctctaaatgaatgttacatgcaattaattttcaatagaatgaatctgcagctaggatgaaagccagttcctttgcttgttttcagaatgaatgtctttctgaatctgatactagagaaatttaatcagagaaacttcaagatgttcaatctcatttattgtctcccaattcatttagtgaacaagatattgatattagtagacacttcaataaaattcagttgtgtttatgtctgttttaacattaatggtgctacttaattttgtataatatgtatttacttatttaaaatgatctgaatttcaacatgtaggcaatgttgggactcctaattgtaaattaggcaaatgcgtttgtaataatgggcatttattacttttaatgataaaatctactgtaaatatttactgagcaactactatgcacaagacagtgggtttcagtgagaggactgacacatggttaaatggagttaactgagtacttgccctttgacccattagattttacagggatattagcagtgaaagatgaattgtatgctcatcagcatgccctaaatggtagaaaatgtctatttgttagatagagatgagggagagaaatgactacatccttgcactgaagtgttgtttgatgacttaccctcatttcctatagtaggaatgggagtgttgatatagttcagtttactcttgaagttctaggtacacagatattatttcctgagaatgtgctgctatgtaagagaggcaaggctgttagtggaaagagtcagacagagctgatttcaagttgtgacccatggtcacttacaccctcaacctcagtttcccagcccagggtataaagtgcatgcatttcatggaatgatagctccagcccttccttccataagacacttctcagatagggagggccgggggagggcagcagtggggaaggagatcttgggagaggaggagtctgagaggccttgcttgggtcagttgccctcccttgttgaaagtgggagaggatcccgtgattgacagttccaacatggcaagcaatagcagagggagagggaggcgctaaagagaggaagaagggatatcagggcagcagaggaccaatgcttgtgagcataaatgtgcttctcaaactgaagaaggagcaattactcttgtcccccatatcctttgcatattaatacttttaaaagatatataaaatacaaatctattttaaattgttaattacatatccaattgctgtaaaactctctcgaagtttgctctccttctctgtgctgatcttgtcacagatgacactcgcagaggtttcactaggctcctctctcacttgctgagaaaaatccctccacatgcacctctaggatccttctacttcttaccttacagtctgttctcagtcctcttttcatttggtgtcaccgtcaccatgctgtgcaaacttcaaggtcctcctttaaaaaattcaatcacaccttatcaggagatctcatcctcaagttcttccaaagcatttcccattccttcatgaccctctgaactcagccacatccttcacaatgccacagttcccctgttcttctgcaaagcctggcacttctttttctttctctaggttaaccttctaatggaggtactttcctaagattctggcctagctgtcaggctcagtacacttcaaaaaggtgaacttcagtgtctgaagtggagttaggggattttcatgaagattgcattttcttcctgtatgagaatgggctaattgtaagatcactgtatgtgtatatttcgaatagtgtctgggagaaggtagcaaatggaatacttgttgaacatagaccatactagccaatttgctaagagaagaaaggcaatcatcacttacatgcaaaatgaagagatgagcaacttctttatttttattcttctcactctatctcccttccttgcaactggagcttaggcaggcaggaggtgaggagctgtagaatgaggaagtcaatagatacatttcttttccagtgacgggtaccttaacttctctgaccctctccgtcctcttcaggtacatgaggttaggcaccatgatctgggaagtcacttccaactcaaaaattctgtaattttttttccattgcctctaatcgtgttgtgtaacctattgatgttctttttcccagggtcttggttatttgttaatcccatatttttgtttgtttgtttgttcttttctagcacttgtgttctgattagtggccaaataaatgacagtcagaacttcagctaaggtacaataaggtaagatcctttttctagttgagctatttccttgaaaagggggattgatggcccaatctgtgagaacagattaacaaggaataagaatgtataagttggtgttttcaacatgatgtacaattgttaccattagtcatgctcaattttttgtgtcttaataaagctaagtgtgttcattttctcatcagtttaaaaatagaaataaagggatgttgattgagatttgaaataagttaactttatttcaaatgcacatttgtatttaactgtagcaatgtggaattttttgaaatattgcaaaatgtttgaattattagtacatatataggatcttatagcttgtctaattcttagaagcttaagaattatccctggatttagattgcccttcttcagaatgctgtacaaaatatgattgtgaacataaacagaaacattgtggaaaagctcaatctttcttagatgttatccttaataatgttttatctatccagcaaacactgctaacatcttaccctaaatccaatccccctgtattagtcccttctcatacagctataaaaacactacctgagactgggtaatttataaacaaaagaagtttaattgtctcacagttctacatggccgggaaggcctcaggaaacttataatcatgacagaaggcgaaggggaagcaagccatgtcttttttgtttgtttttgagacggagtctcgctctgtcacccaggctggagtgcagtggcgccatctcagctcactgcaagctccgcctcccgggttcacaccattctcctgcctcagcctcccgagtagctgggactacaagcgctgccaccatgcctggctaattttttgtattttcagtagagatggggtttcaccgtgttagccaggatggtctcgatctcctgacctcatgatctgcccacctcagcctcccagagtgctgggattacaggcgtgagccaccgcacccagctaggcatgacttacatagcggcaggagagcggggagagggtgcggaggaaactgccacttttaaaaccatcagatctcaagagaactccctcactatcatgataacagcatgggggaaaccaccttcatgatccaatcacctcccacaaggcccctccctcaacagatagagattacggttcgagatgatatttgggtggggacacagagccaaaccttatcactaccctcttcgttcctaacaaaatcttgctgttgtaaggacagcaaagtgcccagctaaaaaatattctcatcttcccagactcttttttctgtggccatgtgacccagctacagccaatgagctctcagtcatggtccctggggagagactttcaagaggagattcctcttagaatgtttttctttgttcttatcccatcattctatcaggaagtcacacccctcccccacccaccccttcttgcaatcacagcaacaaaagccgaactggggatactggagcaggaagataaaatgagcttgagctctggcaagcccatcatcagatttcttgttgcatgagacacatacagtccctaatttagaagagcttattaggttttctgacactcagagccaaatgtagacttagctgattcagtaacattcatatctggatatcatgctggacacattaccctatcttacttaaacactgcagcagtgctattaagtcgagtatttttatttccattttatgtatgaggaaacaggctctgagatgttaagaactttgtcctgtgaactttgtcctatggtagtaagtggcacaggtgagattcgaacttggacctgtcagatgctgatccctgtacacagctgcctcgatgctggtcctgacagcctggttccaggagcctgtgctattgctgattacattttatagttagtcaggggacattgtcagctcagtaaccctttgaatacaatactcttcaatagcacagactttctattatattttgcatttgtaaaactaagtgaactgagtctattcctgtataacagaaacgagagagagagagaaaggaataaagatagagagcaaaagcaagaacaaacgaaagaaagaaagaaagaaagaaagaaaggaaagaaagaagaaaagaaaagagaaaaaaaagaacagaaaagaaaaagagaaaaacagatctgatttgggaaaatcagtttatattggaattgcctatgaaagctggtaaaggaaatattaattctgagcatcttcttttctttttttttttgaaataaaagtttagaactaatggtcaaaatatggtcaccaaaactcagcttttacccaacaatcatagaattaagtattctccgcctaacaatcttcattaattcactcttgttgacttggttcagaaaaaaaaatacaggttaaaaactaagtcatataatgaaatttctttccgaagaaagttatacaaggcattgagtaaggcacggagctgacttgggggatgggggagctggataatggaaaaatcttttggctggaaaataagagactggaaatgcaggggatagcctagcaatttttggcattataaaaagccatttcacctctctggacctttgctgcttatttgtaaattgaaggtataagttattctgatatgctgttagtacaaaataatagcttacctccttgggtctccattgctaatgcagggaaatactctgatatctattcaaagctacagtttttatttctggccattgaaactaagagtgaccagttattttccttttccttctatttcttccaaatacatcctgaatcccttgtctcttttgttatgactctactccaagtcatcatcttgtcttgcctggacaatggcattagcttcatgttagtcaacatggctttcattcttaccatacaaaattacattctgtcacagccagcgtctgctttgggaaacctccatcagatcttgttattctcctatttgagaccttctcaaaatccttcaactccctcccctacatttagaatcaaatccaaatgcattaacatgacttataaatctgatatgatctggtttctacttgtacttttctctcttgcttcctacactccaagcctccctgtctttatttattgaatatttctctttgttctttgccctcaggggcctggcactgatcccctggctcttgtttactacttgacccttccagtcaaatctcaactgccaagacctctcctaaccgctctctaaataaccactgtcctggacacccaggtttaattccctttaaagactggaagttttatttcttaaggcatacgaaaataaccacttatggacaaaatacttacatatgtaacttaagggacttaggtaagacatgacgaattctgtcgcacctgtttatattttgtcgtttatctcccattataatatcatctaagccccatgagggcagggccttgtctgtttccttcactgccaaaaccaccatacttataatgatgcctgccccctgcaagaggcttagtaaatgtttgttgagtaaatgaatatagagtcagaaaatgccctacgttaaatatcttaaaagaaattaagcaattcttatagatgtccccaacgtgtcttttgcttagatgggaagaaaaagaaaaagaaaacagagaaaaagatgaagaaacaatctaggaagaagaacagaaggacagacagtggtataaatagaaaatagtggtaaatccttgggtgggactgtttcagggatctttactcagtggcatttctgatctataatattgggcgacagggctccgttctttggatcttacatagatttattggctaaacctggcgcatgcacaatgagaaatgtttgttgaatgaaggcccgaaagaatgaaataataaattattgaactgcaaagagcaaaattttccctgtttttatgggcatgataatattcccttgatgccagtatttaatccatgttagtaacaaacattccagataacaatgactgtgaaaaatatcccgtgaaacaaaagtcagtcactgtgccaggcatttcccttagcacatttcagagtttattctgtcttcaagggaattgtcacagtgactatccagaatggcacagggtgttaatgtattaaaaatactgacaggaaaatgaaaactagaaaaacgtcttatctgtcaattaaatgatatagcctcgtggttacattacagcaattctggggctttatctttgctgccgattgagatttgacagctgtttgtaaaatatttacattctgatttctgtcacattgacagcacttttgggtctttggaagatgataattatatgtttggaaaatgttaaaaaaatggaagctgatctgttgaggagaaaaatctgtttttaaaattgtgcaaaggaagggcacccactttattaatgaatgtgcgtctaataaaagtcagaagcagtagattcttgtgatccaaaaacatgctacatgtaatgtgcagtagtatccctcccaaccctgcctgctttgggtacctcagcttttcttcatcagctgtgtgtgtggctggccacatacttgttatgcttttccactttattatgcacataaaatggcaatatttggatggcacattggataggattttggagtatctatatgaaattttgtgaaagaagttcagtttgtatcctcggtattaaaggaagagaaaataaaaagtattgggaggaatagtaagtattgaatttatatagaacttccaaataaagtcttttcaaagattttaatgagaagtatacatttatatatacatttatattatcaggtatacagaaatgatgacctgtaattcttgatcaatggtcttatcaaagtcttttgtttggttttgtaaatttattttctgctctaacatgttactacatcactaaatattctttttaaacaccattatgtttatatgcgtagaaaatgtgcataatattctatagcatacataaatattcctgatcatttccagtatttcacgttaaaaattttaatattgatgaagatcattgttaataactttctacacatatcactgaatatcttccttagaatatagtcccagaaatgaaattccttgatcaaatggtacacaaatttttaaggcttttgatatttactgtatggttttcctttcatcaaagtcttttttttttttttttttttttttggtgaaatgctcttttattacttgctaacagcatttgttattaccaagagtagtgagtctgaaagcctttgctcttcactcgtcccaaggtcaaccccacacaacaccgtggggttgccaaatcccatcatagcagcacctgactgctcctgtgagcttcacatttttcttttttttttttttggggaatttgtatttctttgtgaattttcttttttttaatttaattttattattattatactttaagttttagggtacatgtgcacaatgtggttagttacatatgtatacatgtgccatgctggtgtgctgcacccattaactcgtcatttagcattaggtatatctcctatgctatccctcccccctccccccaccccacaacagtccccagagtgtgatgttccccttcctgtgtccacgtgttctcattgttcaattcccacctatgagtgagaacgtgcagtgtttggttttttgttcttgcaatagtttactgagaatgatgatttccaatttcatccatgtccctacaaaggacatgaactcaccattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccagcagtgtaaaattgttcctgtttctccacatcctctccagcacctgttgtttcctgactttttaatgattgccattctaactggtgtgagatgttatctcattgtggttttgatttgcatttctctgatggccagtgatgatgagcattttttcatgtgttttttggctgcatgaatgtcttcttttgagaagtgtctgttcatgtccttcgcccactttttgatggggttgtttggttttttcttgtaaattggtttgagttcactgtagattctggatattagccctttgtcagatgagtaggttgcgaaaattttctcccattttgtaggttgctggttcactctgatggtagtttcttttgctgtgcagaagctcgttagtttaattagatcccatttgtcaattttggcttttgttgccattgcttttggtgttttagacatgaagtccttgcccatgtctatgtcctgaatggtaatgcctaggttttcttctagggtttttatggttttaggtctaacatttaagtctttaatccatcttgaattaattttcatataaggtataaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtatgatgcctccagctttgttcttttggcttaggattgacttggtgatgtaggctctattttggttccatatgaactttaaagtagttttttccaattctgtgaagaaagtcattggtagcttgatagggatggcattgaatctataaattaccttggacagtatggccatttttacgatattgattcttcctacccatgagcatggaatgttcttccatttctttgtatcctcttttatttcattgagcagtggtttgtagttcttcttgaagaggtccttcacatccctagtaagttggattcttggtattttattgtctttgaatcaattgtgaataggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttctcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagattttgtagcatgaagggttgttgaattttgtcaaaggccttttctgcatctattgagataatcatgtggtttttgtctttggtttctgtttatatgctggattaccttgattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggtagtgtctctgcccggctttggtatcaggatgatgctggcatcataaaatgagttagggaggattctctctttttctattgattggaatagtttcagaaggaatggtaccagttcctccttttacctctagtagaattcggctgtgaatccatctggtcctggactctttttggttggtaagctattgattattgccacaatttcagatcctgttattggtctattcagagattcaacttcttcgtggtttagtcttgggagggtgtatgtgtcgaggaatttatccatttcttgtagattttctagtttatttgtgtagaggtgtttgtagtattctctgatggtagtttgtatttctgtgggatcagtggtgatatcccctttatcattttttattgtgtctatttgatccttctctctttttttctttattagtcttgctagcagtctatcaattttgttgatcctttcaaaaaaccagctcctggattcattaattttttgaagggctttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttaatgtaggtgagcggttttgcgtgagtttcttaatcctgacttctagtttgattgcactgtggtctgagagacagtttgttataatttctgttcttttacatttgctgaggagtgctttacttccaactatgtggtcaattttggaatcggtgtggtgcggtgctgaaaaaaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggattgcaacccctgcctttttttgttttccatttgcttggtagatcttcctccatccttttattttgagcctatgtgtgtctctgcacgtgagatgggtttcctgaatacagcacactgctgggtcttgactctttatccaatttgccagtctgtgtcttttaattggagcatttagtccatttatatttaaagttaatattgttatgtgtgaatttgatcctgtcattatgatgttagctggttattttgctcgttagttgatgcagtttcttcctagtcttgatggtctttacaatttggcgtgattttgcagtggctggtaccggttgttcctttccgtgtttagtgcttccttcaggagctcttttagggcaggcctggtggtgacaaaatctctcagcatttgcttgtctgtaaagaattttatttctcctccacttatgaagcttagtttggctggatatgaaattctgggttgaaaattcttttctttaagaatgttgaatattggcccccactctcttctggcttgtagagtttctgccgagagaccctctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatccggcagagtgttttccaacttggttccattctccccgtcactttcaggtacaccaatcagatgtagatttggtcttttgacatagtcccatatttcttggaggctttgttcgtttctttatattcttttttatctaaacttcccttctcgcttcatttcattcatttcatcttccatcactgatacctcttcttccagttgatcgcatcggctcctgaggcttctgcattcttcacatagttctcgagccttggctttcagctccatcagctcctttaagcacttctctgtattggttattctagttatacattcttctaaatttttttcaaagtttttaacttctttgcctttggtttgaatttcctcctgtagctcggagtactttgatcatctgaagccttcttctctcaactcgtcaaagtcattctccatccagctttgttccattgctggtgaggagctgcgttcctttggaggaggagaggcgctctgtttttagagtttccagtttttctgctctgttttttccccatctttgtggttttatctacttttggtctttgatgatggtgatgtacagatgggtttttggtgtggatgtcctttctgttttttagttttctttctaacagacaggaccctcagctgcaggtctgttggagtttgctagaggtccactccagaccctgtttgcctgggtatcagcagcagtgtctgcagaacagtggatgttcgtgatccgcgaatcctgctgtctgatcgttcctctggaagttttgtctcagaggagtacctggcagtgtgaggtgtcagtctgcccctactggggggtgcctcccagttaggctgcttgggggtcaagggtcagggacccactggaggaggcagtctgcccattctcagatctccagctgcatgctgggagaaccactgctctcttcaaagctgtcagacagggacatttaagtctgcagtggttactgctatctttttatttgtctgtgccctgcccccagaggtggagcctacagaggcaggcaggcctccttgagctgtggtgggctccacccagttcgagcttcccagctgctttgtttacctaagcaagcctgggcaatggtgggcgcccctcccccagccgcgctgccgccttgcagtttgatctcagactgctgtgctagtaatcagcgagactccgtgggcgtaggaccctccgagccaggtgcgggatataatctcctgctgtgcccttttttaaacccgtcggaaaagtgcagtattcgggtgggagtgacccgattttccagatgccgtctgtcacccctttctttgactagaaaagggaactccctgactccttgcgcttcccaagtgaggcaatgcctcaacctgctttggctcatgcacggtgcgctgcacccactgtcctgcgcccactgtctggcactccctagtgagatgaacccgg

SEQ ID NO: 12791 - DNA, 6178 bp, Homo sapiens
tgattttttttatttttttattttattttattattattatactttaagttttagggtacatgtgcacaatgtgcagcttagttacatatgtatacatgtgccatgctggtgtgctgcacccattaacttgtcatttagcattaggtatatctcctaatgctatccctccaccctcccccccccacaacagtccccagagtgtgatgttccccttcctgtgtccatgtgttctcattgttcaattcccacctatgagtgacaacatgtggtgtttggttttttgtccttgcgatagtttactgagaatgatgatttccagtttcatccatgtccctacaaaggacatgaactcatcattttttatgactgcatagtattccatggtgtatatgtgccacattttgttaatccagtctatcattgttggacatctgggttggttccaagtctttgctattgtgaatagtgccacaataaacatacatgtgcatgtgtctttaaagcagcatgatttatagttctttcggtatatacccagtaatgggatagctgggtcaaatggtatttctagttctagatccctgtggaatcaccacactgacttccacaatggttgaactagtttacagtcccaccaacagtgtaaaagtgttcctatttctccatatcctctccagcacctgttgtttcctgactttttaatgattgccattctaactggtgtgagatcgtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttttctcgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccattgcttttggtgttttagacatgaagtccttgcccacgcctatgtcctgaatggtaatgcctaggttttcttctagggtttttatggttttaggtctaacgtttaagtctgtaatccatcttgaattaatttttgtataaggtgtaaggaagggatccagtttcagctttctacatatggctagtcagttttcccagcgccatttattaaatagggaatcctttccccattgcttgtttttctcatgtttgtcaaagatcagatagttgtagatacacagcattatttctgaaggctctgttctgttccattgatctatatctctgttttggtaccagtaccttgctgttttggttactgtagccttgtagtatagtttgaagtcaggtagcgtgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccatgttcacgatattcattcttcctacccatgagcatggaatgttctttcatttctttgtatcctcttttatttcattgagcagtggtttgtagttctccttgaagaggcccttcacgtcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttaaggggatttttggctgagacaatgggattttctagatatacagtcatgtcatctgcaaacagggacaatttgacttcctcttttcctaattgaataccctttatttccttctcctgcctaattgccctggccagaacttccaacactatgttgaaaaggagtggtgagagagggcatccctgtcttgtgccagttttcaaagggaatgcttccagtttttgcccattcagtatgatattggttgtgggtttgtcatagatatctcttattattttgagatacgtcccatcaatacctaatttattgagagtttttggcatgaagggttgttgaattttctcaaaggccttttctgcatctattgagataatcatgtgatttttgtctttggctctgtttatatgctggattacatttatttatttgcgtattttgaaccaaccttgcatcccagggatgaagcccacttgatcatggtggataagctttttgatgtgctgctggattccatttgccagtgttttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtaccgctggtagaattcggctgtgaatccatctggtcctggactctttttggttggtaagctattgattattgccacaatttcagagcctgttattggtctattcagagattcaacttcttcctgctttagtcttgggagagtgtatgtgtcgaggaatttatccatttcttctaggttttctagtttatttgcgtagaggtgtttgtagtattctctgatggtagtttgtatttctgtaggatcagtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttgctgctttctcttgtgggcatttagtgctataaatttccctctacacactgctttgactgtgtcccagagattctggtatgttgtgtctttgttctcgttggtttcaaagaacatctttatttctgccttcatttcattatgtacccaatagtcattcaggagcaggttgttcagtttccatgtagttgagcggttttgagtgagtttcttaatactgagttctagtttgattgcactgtggtctgagagacagtttgttataatttctgttcttttacatttgccgaggagagctttacttcaaactatgtggtcaattttggaataggtgtggtgtggtgctgaaaaaatgtatattctgttgatttggggtggagagttctgtagatgtctattaggtccgcttggtgcagagctgagttcaattcctgggtatcctttttaattttctgtctcattgatctgtctaatgttgacagtggggtgttaaggtctcccattattattgtgtgggagtctaagtctcttggtaggtcactcaggacttgctttatgaatctgggtgctcctgtattgagtgcatatatatgtaggatagttagctcttgttggtgaattgatccctttaccattatataatggccttcttcgtctcttttgatctttgttggtttaaagtctgttttatcagagactaggattgcaacccctgcctttttttgttttccatttgcttggtagatcttcttccatccttttattttgagcctatgtgtgtctctgcatgtgagatgggtttcctgaatacagcacactgatggttcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtgtcgatggtctttacatttttgcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccgctgttagtctgttgggcttccctttgtgggtaacccaacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctaggttggggaagtgatcctggataatatcctgcagagtgttttccaacttggttccattctccccgtcactttcaggtacaccaatcagatgtagatttggtctgttcacatagtcccatatttcttggaggctttgttcatttctttttattcttttttctctaaacttcccttctcacttcatttcattcatttcatcttccatcctgataccctttcttccagttgatcgcatcagctcctgaggcttctgcattcttcacgtagttctcgagccttgtctttcaggtccatcagctcctttaagcacttctctgtatttggttattctagttatacatttgtctaaatttttttcaaagtttttaacttctttgcctttggtttgaatttcctcctgtagcttggagtagtttgatcgtctgaagccttcttctctcaactcgtcaaagtcattctccatccagctttgttccattgctggtgaggaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctggatatcagcagcggtggctgcagaatagcggattttcgtgaaccgcgaatgctgctgtctgattgttcctctggaagttttgtctcagaggagtacccggccttatgaggtgtcagtctgtccctactggggggtgcctcccagttaggctgctcgggtgtcaggggtcagggacccacttgaggaggcagtctgccagttctcagatctccagctgcgtgctgggagaaccactgctctcttcaaagctgtcagacagggacatttaagtctgcagagcttactgctgtctttttgtttgtctgtgccctgcccccagaggtggagcctacagaggcaggctggcctccttgagctgtggtgggctccacccagttcgagcttcctggctgctttgtttacctaagcaagcctgggcaatggcggccgcccctcccccagcctcgctgttgccttgcagtttaatctcagactgctgtgctagcaatcagtgagactccgtgggcataggatcccccgagccaggtgcgggatataatctcctggtgcaccattttttaagcccgtcggaaaagagcagtattcgggtgggagtaatccgattttccaggtgctgtctgtcacccctttctttgactaggaaagggaactccctgaccccttgcacttcccaagtgaggcaatgcctcgccctgcttcagctcacgcactgtgcgctgcacccactgtcctgcgcccactgtctggcactccctagtgagatgaacccagtacctcagatggaaatgcagaaatcactcgtcttctgtgttgctcgcgctgggagctgtagaccagagctgttcctatttggccatctttgctgccc

SEQ ID NO: 12792 - DNA, 39295 bp, Homo sapiens
  misc_feature (15686)..(15686): n equals a,t,g, or c
ttatttattttttttattatactttaagttttagggtacatgtgcacattgtgcaggttagttacatatgtatacatgtgccatgctggtgcgctgcactcactaactcgtcatctagcattaggtatatctcccaatgctatccctcccccctccccccaccccaccacagtccagagtgtgatattccccttcctgtgtccatgtgatctcattgttcaattcccagctatgagtgagaatatgcggtgtttggttttttgttcttgcgataggaaaacagttattttaaattgtcattaagtaatataatgaattatagtacagttttctgtttagcaagggagactgaataatccaggcataaagggaaacttggcccatgtattaggaccatgtgcgtgcagtgtgtgtatgcatgaatgtttcgtgcattaaaattattccagatgagccttaaatagcagtcttttttgttccaccttactctctccgttgagactgctgtacaaatgctgcctgggtggattgggaaatttctaggcagtctgctagcaagaaaggctgcaaaatcaataaataaagagatggcttatactctgtagatagactatgtttgaggaagaagcacaaagggcaactatggctgtctcactttgttgcccaggctggaatgcaatggtgcgatcacaattcactgcagcttgatttcatggggtcaagtgagtgattctacattagcttcctgagtagctgggagtacaggcaagcaccaccatgcttggctattttttaaattttttgtagagacagggactcaatatgttgcccaggcttgtctcgaactcctggccttgaactatctttccaccctggcctcacaaagagctggaattggaagtgtgaggccacctggccaccctaagtaatttggcccttcctcagctatctcactgtgtgcaacttcttggaaagtacgctccagttgccttttttcactgcctccaattcagtggtttcttcttccaattggtccctgggcttttctttgattgaaagttttaaattactgattcagtctccttatttgttattgatctgttcaggctttctatttcttcttgattcaatcttggtagcttgtatgtttctaggaatttactcatttcttctaggttgtccaatgtgttaacatgtaattgttcatattagttccttttaaaaatttctttggcattggttatatctcctatttctgattttatcttattttttcctagtttagttaagggtttgttgattttgattatcttttttaaaaaacttttcagtttgtcgatttttcttttgttttctggtcttcatttatttctgctctagtctttattatttccttctttctgctagttttgggcttatttctttttctagttccttcaggtatgatgttaggttgtttgagatcttttttaatgtagacatttatacacttttttaatgtagacatttatacacttccatttcagcactgcttttgccgcctcccataagttttggcatgttatgtttttgtttgtctcacaatatcttctaatttttaaaatttcttctttgacccaatggttgaatatattgtttagtttccatgtatttgtgaatttttccagttttcttttattgatttctagtttcatttctttgtagtcaaaaaagataattgaaattatttcagtcttcttaaatttgtcagaacttgttttgtgaccttgcatgtaatctatcttggagaatctttcatgtgcagttgagaggaatttttattctgctgccgttaggtagaaggttccgtacatgtctgttagctccatttggcctatagtgttattcaaaaccactgtttctttatttctctaatgtctggatgaactattattgaaagtggggtattgaagtctcctaatacattctactcctatttctcccttcatatttatcaatgtgtgctttatatatataggcgctctgatgttgggtgcatatataattgttacgtcttcctgttgaattgacccttttatcattatgtaatgaccttctttgtctcttgtgacagtttttgacttgaagtctttttgtctaatataagaaaagctgcttacgctctgttttggtgaccatttgcatgatatatcttgtttcatcccttcactttcagcctacgtgtgtccttaaagctaaagtgagtcttttgtagacaccctataattagatcttgctttttaatccattcagctactctgtatctttgattggggaatttaatacatttacatttaaagaaattattgattggtaagaactgactactgccattttgttcattggtttctgttttgtggttcttttgttcctctcttcccctcttgctgtctttgtgatttgataattttttatggttatatactcggattcttttccctttcttgtatctgctgaagattttttctttgtagttactgtgaagcttgcataaccctccttagaattgtaccagtctattttgagctgataacttcaatcacatacaaaaactacacttttactctcccattccccagtttgttattgatgtcagaatttgctttttatgttgtgtatccattaaccaatattttgtggttatattcttaatacttttgtcttttatgctggggttaaaagtgatttatgcaccaccattacaatattacattattctgtatttgtctatgtatttacccttagcagtgagatttatactttcatatgcttttgtgttgctatttagcaagaagctgatttttttattaatacaaattatgtacttttttcaaaataaagaatttgttgtatgtatgtattacacacagatttccaaaccagataacccagtgttggccaatcgcagtaatcaaaactacaaatttaatttcataatttttagctccttgcagctgctgctgtcagacaaccctcagctgggtggtgtcaggattggtagcattttcaaataaaacaagaaatttaacatcaataggtaccagcaagaagtgtttatttcttcatgagggtgttgtgtacttcgggggaataagaccaattttcattttggtagttaaatgggttgcatttgaaacctttgctgtgaggcaccatatttccaatgagtgaagttttagactctttacatttggtaccacaagtaccattaatggggttgtggctgggcagtatagtcaagtgattctctgaaggcagaaataaataagcagatcgtttactttttcagtataactccacttgttaggcttttagcctcttctttcaacataggtttaataaatagggaataatcttaactagccaccactgccaggtggtgctacttccctttctgctgtttcatgatcccaccacactgtgttaatcctcaccagtggttgtcctgtgattggctgctgtattataggctgcggtaagcagaatagtgactcccgaaccacgacccccaaacacgcaaagatgtctacgtcctaatccttggaaactgtaaaaatgtaactttacatggcaaaggggaattaagattccagatagaattcagtttgctaatcagctgatcttaaaacagggagagtatcctgggttatctacatgcacccaatgtaatcatggagtttcttaaaagtgggagagggaggcagaagagaaggctggagtgacaagatttgaggactgagtccattattgctgattttgaagacggaggaagggcacggtgagccaacaaatgcaggcagcctttagaagctggaaaaggcaaggaaacagtctcctagagtctccaggatgaaatgtcgacctaccaacaccttcattttagcccagtgagacccatctaggactgctgacctctagaactgtaagacgatacatttgtaggttgtaagccattacgttagtggtaatttgttacagcaacaatagaaagtaaatatacagactggtggaggacagatgcaggagaattctcatctttgaagactgaagtattgattaatattttgggctggacatttaaatttctaaatcaagattatgttttacaaatattaagtgattttgaggcttgtttcctaagcatgatcagaaaatcctcaggtctgctagggattgttatctaaaagcagagaaaaactttttccagtggataaaatttaaagagagaatagaaaacaaaaataaatttgcattttgattacatcccttaggctgtgattgtttaatgtacttcttataatagtatctaaacaaatgtaaaatattataaatgtaatattttcatttatcaaatatctctttaatcattcagcaaatatcctgacagtttctgagccttgtttgtaagatttccttttagttctgtgagaacctaggatcctttcattgagttccttttctacttaaattagctagagctggctgctgttgcttacaatgaacgtagaacgctaactgaggtaggagacacactagcactttgcatctagagagatgtgtgactgcggataaattattctttgcttgtgatatccagcctcccagatggccccctgtgattcttgctatctcttgactaattccctcacattgttctatggttggactatgagtttagaagcatgcaggagaagttatgggatgtcacttccaagattaggttatgaaaaactgatttccttcttgggtgctttatctgatactatttgctctaatgtcatgggtcataagccatgtcatgaacagctttgtggagaggcctacatcatttggaactgaagcctccttccagtagacatatgagtcaacatggaagtagatgcttcaacccttgacaagtcttcataaacttagccctggcttgactaccacctcatgaaggctctgagtcataattgcccaactaagtcactgctggattcctgactctcagaaactgtcagataattattgttttgagctgctaaatttggggaccatttgttatgctagtatggataactaatacacgttcataaacccactttgagaggagataaggcagggtaaaggatggagcatttttttcttttttatgtttctaaagaggaattttttatgcactgtgaagcttgagaaagctggtcagattatctgtatctatgtaaggcttaactatgactgcagaaatttgggaattagcccttctgacaatttaagaaagggatttgaaattaattagacacctattattaaacaggcatttcattatgtactgtttcagtcacttttgctgcataacaaatcaccccaaaatttgcgggcttaaaaaaaagtaattttcccccttccctgttctgtggattgatcaggtgtttttttttttttttttggcattgtcagggttcactcccacagctgcatttagctgcttgattgcctggggctgggctcatctgagtcaactaggcccctctctccatgtagtcattcatcctcaaggagaaagaccaaagtttttcacatgatgacggccacttcacaagacagtgtaaatagaagctgcctgacttgttatggtctagcctttgaagtcacagtatcatttaggttgcattcaattttttttttttttttttgagatagggtctctgtcacctaggctgaagtgcagtggcgtgatcacagctcactgcaacctctgcctcccaggctcaagtgatcctcctacctcagcctcccaagtagctgggactacaggcacatggcaccatgccaggctaactttttgtgttttttgtaaagatggggtttcaccatgttgcccaggctggtcttgaactcctgggctcaagtgatccacatgccttggcctcccaagttgctgcgattacaagcgtgagctactgtgcctggcctaggctaaattctattataataaaacaagttcagctcagattaaaggggtagagaagtagattctacctcttgatgggtggggtggcaaagtcactttgcaaaagcaggtggacacaggatattgtagttcattgggagccattatagtaaaaatataccacaatctgcattctctcccagtaattcaagtcccttcccaagactcccaaagtctcatccagttatggcatcatactcaaaatccattattttataatctgtctgcattaggtccaaaagcagtatgtgttcttcttgacgcagacaccagagaactaaaagaagtttgctgccctcctcacttccatccaacacacaaaggtgaggcagagagagaatattcacatagatattctcattttaaaaatgtgaggaatggaaggtacttagcaatgattagcctgtatgaattttgaaatctatctggacacacattgccaggacccattcctttggtgacagggaatacttgatgagaactcactttgcttccttggagtgattgtctagtcctgttttttttttttcccagcttttggctctgctgtgatatttgggttctgcccttccgagatgtttttccttttcaataaaaatggcccatctttgtagctgagtagacttcccagcttgtttaccacctataaaaaatttagcaccaaactctcttcattgtgaatggtctttgtcccttctaattcaaaccagtggtgctctcaccaatataataatctcagaaactgtgtgggtttgctgcgtgtcttattggggtttactccataccccaaagccataattctttttgagacaaacctctctaatttgtcccacaggtgagacaatgttttaaggttcttagaaatccttttaccttgctgagaaatgtctgctacgtgttcccttaaatctgatgtcttaacaaaagatcttggccgggcatggtggctcatgcctgtaatctcagcactgtggaggctgaggcgggtggatcacaaggtcaggagatcgagaccatcctggctaacacagtgaaaccccgtctctactaaaaatacaaaaattagctgggcgtgatggtgggcacctgtagtcccagctactcaggaggctgaggcaggagaatgacgtgaacccaggaggcggagcttgcagggagccgagattgcgccactgcactccagcctgggcgacagagcgagactctgtctcaaaaaaaaacaaaaaacaaaaaacaacaaaagatcttaccaccagccacatctttaattcaacactaaggtcatctcttattttgatgatgttttgctgattggagatattagaaatactgaacagttttctttcctgatctagaacaccctagctcttttttctctaaatttgacttgcaaactgaacaattcttttgtttatctttttctttccatgctgcatcatacacagcttaaaaaaaaaaaagccaactgattctcccaaattttgcttttaaatcccctttgccagactcacaagtttattaggtggatttcttaaccttctgagttaccatgggcaacagttttaccgatttttcctctcctacagaatgtgggccatcctctctccagtttctaatagttacctgataccatatgtttagtttttttgtttggtataatagcaccccacccctatttcagcctttattgcataactactccaaaatttatggcttaaaacaacgatttattatttcttagggttttgtgggttggttggatactgctgctgggcttgcctgtggtcactcatgtggctgcagtcacctggcaagttgatggaggactgggcttagcttgcatgctgggcctctctatttgaacattcgtcttcaaggaagctaggctggactccttcacccggcaatgactgtgttccaagaaagcagacatggatgcttgtagggggcttctccatagcccagcttcaacagtcacacaatgccacttaggcatcctgttggccaagatgagtcacaaggccatcccaaattcaaaaggaggggacacagaccacctctcgataagagagagcatcttttttttttctttttggcagagtctcactctgttgcccaggctggagtgcagtggtgtgatcttagctcactgcaacttccgcctcctgggttcaagctattctcctgccttagcctcctgagtaactgggattacaggctcacaccaccatgcctggctaatttttgtatttttagtagagaaagggttttgccatgttggcccgctggtcttggacacctgagctcaagtgatctttctgccttggtgtcccaaattgctggggttacaggtgcgagccaccatgctgggcctgagatagcatcttcctgagcagcctgggaagatagagtttacagtcttctaaaatcatacatcttgtgggtatagaaatcgtctcggagtcagatgtttcaatcagctcatgaaaaacagctttttaatttcccctctcttttctttttttttttgagacagtgtctcactctgtagcccaagctggagtgcagtggcacgatctcggttcatgcaacctttgcttctgggggctcaagtgattctctggcctcagcctcccaagtagctgggaatagaggcatgcaccaccacacttggttaattttttttgcatttttagtagagacggggtttcaccatgttgccctgggtggtctcaaactcttgagctcaggccatccaccttcctcgacctcccaaagtgctgagattacaggtttgagccaccgcacccggcctgcttcccatctcttttctaagggagaagtctgtcggcaaataaaagttgacatgccttctaacatcatttctatctcttgttgctgtttatctttggaagtggcctgcttaaagatacatattccattttaaaaagctattatttggggtaaaatatcacacaaagctcagaaagctccaatatttagtaacttgtgaaaatgtagaaactatgagaaatattggggtaaaagcatagtgaagaagagagcaagggaaagatcattaaaaatagaaattgaacagaaaacaaaggataaacatgatttccagcatgagtgtgaaaacactgatttctcattttgacaagtgaggcagaagcctttacttctgtttatttgggggctacagaatggagtgtttgtgttatctgaaatagtgtctttcttctaacctagggtcccatacactctcctatgctttgcaatataaataaaggcaacgcacactgaactgctaggagaacaatcaggccttgtccatacaagaacacaggagaggcaatgcagacatctcatatgaagcagaactaggcaatctccaagaccgctcctcaccccaaaattcaatgatagggtgaaattcaaaagtgaatatgataactgagttttcctaaaatggtctcagttgtctgctttcaaactaagctacatttaaaaacagatatgacaatctgtagcttagattcagtttgcatctgtttacagatgttatgcctttgttctcagggattatcatttttatttttagccagctttatttttttaatatgtaaaactttctacaaatgaaaaggcatgatctaatttataggttatatttatatggtcataaaaccccatttgcagctgtggctgaatgaatttctcacatattcaggcattatcttgagttatacttgttaatatgctcatttgtagtaacggatgtgtctgttactcagtgggtcagctctactaagtcacgcaactgagacggttcaatagatcagtttaaagttcatgataaacttgcactgccgcaaagctttctcagaatcatttgggagtattcataagcctggcatgccttctgcccttgggttcgatttttgccatctcatgtttatattcaacttagaaatctgcttttcagagacttctgggtttagaattcactgtgggctttaaagacaagaagagaattgctcatataataacacaggcttttggctcctcagatcttctgttgagctgtggcttggcaatggtgacactgttaattttattctgccatgcagagaaccagtaaattagagtaatgggttgtgctgtcaatcaggtttaacagaacctctaagagattttgcaagggaatgaaatcaacatggtccagttgtactatatcatgattaacagtatatcttaaggaaacatgttttttaaatgctgtaaagtgcatttctttatggtgaatatattttccactgcatgctttctacacaattgtaaatatggtccttggggtattaatttatggcccttttaaagcaaagtttaagtatagaatttaaaaacatatatatatgaaagagaatgtcttaaaaatggagtgaattgcctttgcataatttcctcttttgagagctgtagaaatgtgcagaagtcaccagagatcgagaagaaaggacgtctaaaagtcaccacagaagaatatgaccgtgagcagggccgtggccagcttctgccttggctgtgcacactgggcaagcaggggagggggactgggctgtttgtcttcagccgggggccaccttcattctctgttactaattctggacagaccaattcttgtctcctgtatttcaaaaagtaattttttttttttttttttttgagacggagtcttgctctgtcgcccaggctggagtgcagtggcgtgatcttgactcactgcaagctccgcctcccgggttcatgccattctcctgcctcagcctcccgagtagctgggactacaggcgcccgccaccacgcttggctaattttttggatttttagtagagacagggtttcaccgtgttacgaggtcaggagatcgagaccatcaaaaagtatttttgcccatacacatttcttgatactctgtaaaacattctggaattttaaacccttggtatgttgtttcttgcctttaaaaagagcatttatgaaccaacataccttttaaaggtcattgataccatttttaacaaggttttgtactttatcattctcatttatcttccattttctaatttttctttcagtatctctttatttccttttactcctatctgaaaatttaatttatattagaaacatactagctatacatgctaaacttattaaatatctactagaattttagagatggaatagttcttagtctggttcaccctgagtattttgactatctgatataaaagaagcaacagatagaaggagaagagtagatgaggaaacagcagataatggcataagtcatgttgtcatcattgggaaggctgggaacaagtcaaatccttctgctgaaaaactctcctaacctacacactcccgaaggctttgtgtgtatgtgcatattgggaggtaggggtggtggtcactgtggtggggctgatgccggagatgccatatttttcctttgcgcttctccccacccacccttgccccagggctctgctttgtgctgaacacacagtaggtgggacttgtgagcacttgtagtcagcacttgttattttcggacttgattatctatcacttttctcagtaactatagaacatagccaataggagatcatccttacagccccaaagggcagaaaatgaagttgacttaatcatccacttgttagcgcaccttactctatgaactcaaaatgcagtggagagaaaagggatggaagaaatttgttcataatgagcaagctaggaagactgctgcaaggtgacttgaattttttaatttaaatattttagacataaaaaagtatttgaggggttgatagctttggaagttaaaggctgctatcagcctgacagagcagttcaaaaaaacagcttgaggataccaatcatttgcttatctttattttagtttccaaaatttcagatggactttgtgaattgagactcttagaaaactgccagtttctatgttttgattttcgtgaaaatcagaaccaaagaggaaaaggtaagtgataatatttttggtttaagaaattaaaccaaagtgtcatggtgctactgaggtgcagtttcacattcttttttcagaagatgagccaataacaaaatgactctgttttatagaatattattttcagtattagatattactaattaagtattacacaaagctgtttagcagaaaaaatgtgatttttcagacagcagaagttgaggaagtctgagtttctgcgttttgacactgactgggtaggagtttctttgtctatagaacagggatttgtagaggaagacctggctgccttggtgagttacaccctctaatcgtgagcatgacgttgtgtaaaaggaaaattgtctttattcttaggattttttttttcttttttaccttgtaatttagcattaaaaacagggagagaacatgccagtcggaatggctattattaaaatgtcaaaaaacaacagatgctggcgaggttgcagagaaaaaggaacgcttttacactggtggtgggagcgtaaattagttcagccattgtggaagacagtgtggcaattcctcaaagacctaaagacagaaataccaatgggatcaacccagcaataccattactgggtatatacctcaaggaacataaatcattctttataaagatacatgcacgcatatgctcattgcagcactattcacaatagcaaagacatggaatcaacccaaatacccatcagtgatagactggataaagaaaatgtggtacatatacaccatggaatactatgcagccataaaaacgaataagatcatgtcctttgcagggacgtggatggagttggaagccgttatcctcagcaaactaatgcaggaacagaaaactaacactgcatgttatcacttataagtgggagttgaatgatgagggaggcaacaacacacactggggcctgtcggagggaggggtcggggagggagagcatcaggaagaatggctgatggatgctgggcttaatacctaggtgacgggatgatctgtgcaggaaaccaccatggccctggtttacctgtgtaagaaacctgcacacctggcacatgtactcctgaacttaaaagttgaaaaaaaaaaaaaaaaaacagggagagaagaaaaagagggtggttatgcaaaaattattttacttaattttttaacccaagctatgttattttatattcataaaaatgctctattcttcaaagggagctttgttcttgaaaaatagtgcagctgtgcctcaggctatgctataacattttcagaaaaccacaatcaagaaggaattgaaaaagagggcacttagaactctcctcaatgggtaaaggaaagttaaaaactttgaaactagttgcctgggaaactgctgacaggggtggggatgggattttggactaggcttcttttttgtctctaagcctgtatcagttcctactgtgaatacaattttttttcccttctgctaggctatgagggaaagcagtttagaagggcaaagtgggtcttgtccctgggaggtgggaatctacaagtggccagcactcctggtagttcagggtggtgcaggataggatggaagctggcggtggggattcgggagctctgtcaactgccaaatgcttgtctgcatcctctgtccctatttccaagatgtatttagggaaaactctgcatagatctcctccttaacaacacccctttcccttttttaagatggggtctcattctgtcacccaggttgggagtgcagtgccataataatggctcactgcaacctcgaattcctgggctcaagtaatccttcctcctcagcctcctgagtagctgggattacaagcacacatgaccatgacaggctaattgtaacaagcccttttgtactgtttgtttttcttgggtactagtcacacagttcttatctttgcatgccagtaatttttcattcaatactggaaattgctcaaaaaaaaaaaaaaaagaggttcctgttgatgatgccattcaacagagaaagttcaagtttttctttgctaagaaatagagtagaagaaagggaaaactcattttaatccagtcagggactgagctgagttgaggttaaatggcagttttggaaagatttcatggctcatcctgtgtgtgctccaatacctagtgtgtgtcccttcagagtttttagttcagagataggtgggtctttgtggtctcagcgccaatggactgtgggaatttctgtcctgtctttcagaggttttcagcttaacactttaatctcccactgtgtacatctttggaattagctgaatgccttgagaagggagaccagctctcaggtttccaattttgtcaaaccaggttttaaatgaccacccaaagctgtgttagtttttatgtctctccagcagagaccctctgtccagaccaagaccagatcctctgactctagccagtgcccagaattggcaaatatctcctggagaaggcagctgcagattctcaactcatttataaaattagtccctggaatttcagtccctctagtatcatttacttttgcagttctctgatacattagaaaatatgattttaaaaaaatgtatcagggttttgtaattgttctcagtgtgagcagtttgctgctatgaattccagcatgtccagaagcagaaatatacctaatgtattatattgtttgtctttttatgtgtgttcttatttttgcccatttggtctgagttggactgagagaaatgaaataaagtctcctactgctgtttccatctgtctctccttgtgcctcccgtgatttctgtttcatcaacatcactgccacattgtttagtatagagatatttatcactgttatatcttcgttttggtttgtattcattagcattataaagtgcctttatatatttatggtatctttttagcttgaattctgccttctgtcatgctgtattataaacaccactttctttttgttttgcacttttctcatatgttttggttcatctttttatttttaacttttttgaataattttgctttcaaggtgccactctaaaaaacagcttcattgtgatataaatgatatacaaagaattgtacatatttaaatacaatttgatgagtttgtacatatgcatacacccatgaaaccaccaccacaatcaaggtaatagacatttctatcacctcaaagttcccttgtgcctatctcttttttttagtggattttgtatgaatgtttaacatgaaatctaccctcaacaaacttttaagtgcacaatacatcaacctgacttgtgaatagcataggaattgggtttgtgacatagatttgtgactcaatctgaaaatgtcttttcttttactaggtaaaagacttacctacattcattggtatggtcaattatagttctatagtcttacatgtgtaacatttaaaaagtctctcctttgtggtctctctctctcttttttgttctagtggctgcatattacaccatttttatcatcttcctcctcctcctcctcctcatcgtggncttcttcttcctcttctttcttctccttctcttcttcctcttcctcctcttccttcttccttccttcttcttctttctttctttttttttttttttttgagacagggtcttgctctgttgcccaggctgcagtgcagtggcacaatcttggctcactgcggccttgacctcgagggctcgagcgatcctcacacctcagccttctgagtagctaggaccacagatgcatgccaccatatccagcctattctcttctttctttagaattatctataatttggctgtgtgcggtggctcacacctgtaatcccagcactttgggaggctgagccgggcagatcatgaggtcaggagacggagaccatcctggccaacatggtgaagccccatctctactaaaaatacaaaaattaggtgggcatggtggcacgcactcgtaatcccagctacttgggaggccgaggcaggagaatcgcttaaaaccaggaggcggaggttgcagtgagccgagattgcaccattgcattccagcctggtgacagagtgagactccatctcaaaaaaaaaaaaaaaaaaaattatatctataattttcttaatgtaattagcattaaaattaacttatattcttttcttccctcttcatccctcccctcaaatatacaattttagttgataatactggctttcttagggtttacttttgtattgttaagtatgctatacttctaaagcttgatttttcaacttgatttatctcttgtttgccaggtataattgatgaagcaactagcgagcttattctttcctccaccttttctttcccccaatctttgctttttaaaaaagttttatgtcgtcaaatcttatatcactttcattctattctgtcacctttattttccccattgttttcatcttatagcttacaggtagatatatttgatgcccatgagaagtccttttgttgaggtttccctggtcattcatgattggttagtttttcccctagttttcttaagaagaattcacatcaacaacattctctgaattcttgaatattccaagtaattagatagtattaactgttgcaagaaatgagatcaaaagctctattgctaacaggagtgtcatttgacacaaccactgtaaaacaggtttgcaacaacttgaaaacttaaacagccattatcctataacctgtaaatttcactcctaccaagataaactcttgcacaggcataaaaggagtcacttacaagactctctattacagcactgtttttattgtgttttgttttttaactttttttttttttttgagacggagtctcgctctttcgcccattttggagtgcagtggcactatctcggctcactgcaagctccgcctcctgggttcacaccattctcctgcctcagcctcccgagtagctggggctacaggcgcccgccatcgcgcccagctaattttttgtatttttagtagagacggggtttcaccatgttagccaggatggtctcgatctcctgaccttgtgatccaccgacctcggcctcccaaagtgctgggattacaggcgtgagccaccgtgcccggcctgttttttaacttttattttaaatttaggggtatatgtgcaggttttgttgcataggtaaacttgtgtcatgtgggtttgttgcaccgattgtttcatcacccaggtattaagcctagtacccattagttatttttcccaatcctctccctcctcctaacctccactctcaactaggtcccagtgtgtgttgttcccctctcatgtgtccatgagttctcatcatttagctttcacttttaagtgagaacatgtggtgtttggttttctgttcctgtgttagtttgctaaggataatggcctccagctacatccatgtccctgcaaagagcatgaacttgttcctttttatggctgcatagtattccatggtgtgtatgtactacattttctttatccaatccatcattgataggcagttaagttgattccatgtctttactattgtgaatagtgctacagtgaacatacacatccatgtgtctttataatagaatggtttatattccctggggtatataaccagtaatggaattgctgggtccatcccattggtatttctgtctttaggcctttgaagaatcaccacaccatcttccgcaatggttgaagtaatttacatgcccactaacaatgtataaatcttcctttttctccacaacctcaccaacatcttttttgacttttgaataatggccattctgactggtgtgagatagtatcttattgtggttttgatttgcgtttctctaatgatcagtgatgttgagatttttttcatatgcttgtttcatatgcttgtttgtcacatttatatcttctattaagcagtgtctgttcatgtcctttgccaactttttaatgagattgttttcttttttcttgtaaatttaagttccttatagatgctagatattagacctttttcagatgcatagtttgcaaagatttgttcccatcctgtaggttgtctgtttactctgttgatagtttcttttgctgtgcagaagctctgtagtttaattagatctcatttgtcaatttttgtttttgttgaaattgcttttggcattaattcgcttaggattatggtctccagctctgttcatgttgctgcaaaggatgtgatttcattctttttatggctgtgtaatattctatggtgtatatgtactacattttctttgttcaatccactgttggtgggcacctagtttgattccatgtctttcctattatgaatactgctgtgatgaacatgtgagtgccttgttttcttttgaatatatatacccagtaataggattgctgaatcaaatggcagttctgttttaagttctttgagaaatctccaaacagctttccacagtggttgaactaatttacattcccaccaacagtgtatacgcattcccttttctccatggtcttgccagtatctgttgtttttgaacattttcataatagccattctgactggcgtgagatgttatctcactgtggttttcatttgcacttcacagataattagtgatgtgcaacattttttgtatatgtgttagctgcttgtatgtctgttttgagaagtgtctgttcatgtcttttgcccaattgttaacagggttgtttgtttttttgcttgttgggttgtttaagttccttatagattctggatattggatctttgtcagattttttttctgacaaatatttgtgactattttctcccattctgtaggttgtttattgtgttgacagtttctttttctttttcttttgttttgttttgtgtgtgtgtgtgtgtttaatattttaagttctggggtacatgtgcagaacatgcagttttgttacatatgtgtaaacgtgtcatggtggtttgctgcaggcatcaacccatcacctacattaggtatttatcataatgctatccctcccctagctccctaccccctgagagtccctggtgggtgatgttccctgccctgtgtccatgtgttctccttgttcaactcccacttatgagtgagaacatgtagtgtttggttttctgttcttgtgatagtttgttgagaatgatggtttccagcttcatcatgtccctgcaaaggacatgaactcatctttttttatggctgcataatattccaaggtgtatgtgtgccacattttctcaatccagtctatcattgatggacatttgggttggttccaagtctttgctattgtgaatagtgccacaataaacatacgtgtgcgtgtgtctttatagtagaatgatttataatcctttgggtatatacccagtaatcggattgctgagtcaaatggtatttctagttctagatccttaagaattccctcactgaattccacaatggttgaactaatttacactcccaccaacagtataaaagcattcctatttctccacatcctctccagcaactgttgtttcctgactttttaatgattgccattctaactggtgttagatggcatctcattgtagttttgatttgcatttctctaatgaccagtgatgatgagcattttttcgtatgtttgttggctgcataaatgtcttcttttgagaagtgtctgttcatatcctttgcccactttttaatggggttgtttgttttttttcttgtaaatgtgtttaagttctttgtagattctggatattagccctttctcatatggatagattgcaaaaattttctaccattttgtaggttgcctgttcactctaatgatagtttcttttgctgtgcagaagctctttagtttaattagatcccatttgtcaattttggattttgttgccattgcttttggtgttttagatatgaagtccttgcccatgcctatgtcctgaatggtattgcccaggttttcttctagggtttttgtggttttaggtcttatgtttaagtctttaatccatcttgagttgatttttgtttaaggtgtaaggaaggggtccagtttcagttttctgcatatggctagccagttttcccagcaccatttattaaatagggaatctttttcccattgcttatttgtatcagatttgtcaaagatcagatggttgtaaatgtgtggtgttatttctgaggcctctgttctgttccattggtctatatatctgttttggtaccagtaccatgctgttttggttactgtagccttgtagtatattttgaagtcaggtagtgtgatgcctccagctttgttctttttgcttaggattgtcttggctatgcgggctcttttttggttccatatgatgtttaaagtagctttttcaaattttgtgaaggaagtcaatggtagcttgatggggatagcattgaatctataaattacttttggcagtatggccattttgacaatactgattcttgctatccatgagtgtgaaatgtttttccatttgtttgtgtcctctcttattttgttgagcagtggtttgtagttctccttgaagaggttcttcacatcccttgtaagttgtattcctatgtatcttattctcttagtggcaagtgtgaatgggagttcactcatgatttggctattcgtctgttattggtgtataggaatgcttgtgatttttgcacattgattttgtatcctgagactttgctgaagttgtttatcagcttaatgagattttgggctgagataatggggttttctaaatatacaatcatgtcttctgcaaacagagacaacttgacctcctctcttcccgtctgaatatgctttctttctttctcttgctgattgccccgaccagaacttccaatactatgttgaataggagtggtgagagagggcatccttgttttgtgccagttttcaaagggaatgcttccagtttttgcccattcagtatgctattggctatgggtttgtcataaatagctcttattattttgagatacatctattgatacctagtttattgacagtttttagcatgaagggctgttgaattttgtcgaaggccttttctgcatctattgagataatcatgtggtttttgtcactggttctgtttatgtgatggattacatttattgatttgcatatgttgatttgcatctcaggtatgaagccaacctgattgtggtggataagctttttgatgtgctgctggattcagtttgccagtattttattgaggatttttgcatcaatgttcatcagggacactggcctgaaattttccttttttgttgtgtctgccaggttttggcatcaggatgatgctggcctcataaaatgagttagggaggattccctctttttctattgtttggaataatttcagaaggaatggtaccacctcctttttatacctctggtaaaatttacttgtgaatctgtctgttcctggactttttttgattggtaggctattaattactgcctcaatttcagaacttgttattggtctattgaaggattcgacttcttcctggtttagacttgggaagttgtatgtgtccaggaatttatccatttcttctaggttttctagtttatttgcgtagaggtgtttatagtattctctcatggtagtttgtatttctgtggaatcagtggtgatatcccctgtattattttttattgcatctatttgattcttctctcttttcttctttattagtctggctagcagtctatctattttgttgatctttaaaaaaaaaaaaaacagctcctggattcattgatttttcaaagggtttttcatgtctctatcgctttcagttctgctctgaccttagttatttcttgtcttctgctagcttttgaatttatttgctgttacttctctacttcttttaattgtgatgttagggtgtcaattttagatctttcctgctttctcttgtgggcttttagtgtttaaattttcctctacacactgctttaaatgtgtcccagagattctggtacgttgtgtcttcgttctcatcggtttcaaataatatctttatttctgccttcatttcattatttacctggtagtcattcaggagcaggttgttcagtttccatgtagttgtgcagttttgagtgagtttcttaatcctgagttctaattggattgctctgtggtctgagagactgttatgatttttcatttgctgaggagggttttacttccaattatgtggtcaattttagaataagtacgatgaggtgctgagaagaatgtatattctgttgatttggggtggagagttctattcctttctgtttattagttttccttctaacaggcctctgctgcaggtctgctggagtttgctggaggtgcactccagaccgtgtttgactgggtatcaccagcgaaggctgcagaacagccaagattgatgcctgtttttcctctggaagctttgtcccagaggggcacctgccagatgccagccagagctctcctgtacgaggtgtctgtcggcccctactgggagatgtctcccagtcaggatacacggggggtcagggacccacttgaggaggcagtctgacccttagcagagctcaaatgctgtgctgggaggtccgctgctctcttcagagctgtcaggcagggatgtttaagtctaatgaagctgcacccaaagctttcccttccaggtgctctgtcccagggagatgggggttttatctataaatccctgactggggctgctgcctttttttcagagatgccctgctcagacaggagaaatctggcagtctggccacagcagccttgctgagctgcagtgggctccacccagttcaaacttcctggcttctttgtttacagtgtgagcaaaaaactgcctactcaagcctcagcaatggcggacacccctccccccaccaagttcgagcatcccaggtcaatctcagactgctgctgtgctggcagcgagaatttccagccagtggatcttagtttgctgggctccatgggggtgggacccgccgatccagaccacttggcttcctggggcttcagcacccctttccaggggaatgaacggctctgtctcactggcgttccaggcaccactggggtatgggaaaaaaacaacaacaacaactcctgcagctacttctgtgtctgcccaaacggccgcccagttttgtgcttgaaacacagggccctggtggggtaggcaccgaagggaatctcctggtctgcaggttgcaaagaccgtgggacaagggcaatatctgggctggagtgtgcattgttccttggattcagttccgtaaggcttcccttgggtaggggagaaaaatcccccaaccccttgcacttcccggatgaggcaacgccccaccctgctttggcttgccctctgtggttgtccaaccagtcccagtgagatgaactaggtacctcagttggaaatgcagaaatcacctgccatctgcatcaatctcgttgggagctgcagaccggagctgttcctattcggccatcctgctagcaattgactgatagtttcttttactatgctctttagttttattagttcctgctttttaattttttggttgcagttgcttttgtggtcttagttgtaatttatttcccaagcctgatgtttcctaggttttcttctaggatttttatagtttgaggtcttacatttaaatctctaattaatcttgagttaacttttgtatatggtgacgggtagggatcatgttttattctcctgcatgtggccagccaactatcctgcacaatttattgaatagggagtcttttctcttttgcttgtttttgtcaactttgttgaagagcagatggctgtaggtgtgtggctttatttctgcattctttattctgttccattggtctaaggtgtctgtttttgtaccaataccatgctgttttggttactgtaaccttatagtatagtttgaaatcaggtaatgtgatacctctggctttgttccttctgcttaggattgctttggcaatttaaagaatgctaaaaataggcccccaatctctcctgacttataaggtttctgctaagatgtctgctgttagcctaatggagttccctttgtatgtgatctgacctttttttttgctagctgcctttaagattttttctttagtgttcactttggacagtctggtgactatatgccttggtgatgttgttttatatagtatcttgcagatgttctctggatttcttgtatctcgatgtctgtctctctagcaagattaggaaacttttcttgagttattccctcaaaaatatatttaccagattgtttactttttcttcctctcaagaatgttaataatttgtaggttttttcacttcacgtaattacaatttcttgaagactgttcgtttttttacattcactttcctttatttttgtttggctgggttagcttgaaagactggtcttcaagctctgtaatttcttctgcttggcccaatctattgataaaacttttaattgtactttgaaactccttaggtgagtttttcaattctagaaggtctgattgatttcttttttttttctttttctttttctttctgttttttttttttttgagacagagactcactctgtcacccaggctggagtacagtggcatgatctcgactcactgcaacctctgcctcctgggttcaagcaattctcctgcctcagccttctgagtagctgggattacaaatgtgtgccaccacgcccagctaatttttgtgtttttagtagagatggggtttcaccatgttggccaggttggcctcgaactcccaacctcaactgatctgcccacctcagcctcccaaagtgccgggattacaggcgtgagccaccgcacctagccctgattaatttctttttaggatgtttatctcttccttcatttcccagagattgctttagaagtttctttgtgttgatttttaaccctgtcttggatatcattgcgttttttttttttcctagtccatgctttgaatactttatctgtcatttcttagtttcaattttggttagcaacaattgctggagagctagtgcaatcctttgatggtatcactacattcatatttttcatggtaccagaattcttgccctggttccttctcatctgagatgctgacacttataattttgtatttattttctagcaggtagaaattttctttttatttctttctctatattattattattttttctttctctttccttttttccatctccccagcaggtataactatagagaatgttgagtagagttgtttggctttgcttctatagctgtatgcacttctgatggcaacttttatactgggctgtgcgcttcaaactctaagcctgtagatggcacttataggtatgagctggttgcagccaatttggggatatacttgacctttgtttactgggagaagctccctgttgcttcaggtaaatgggctgatccatggagtgcacagtggtctgagcttcctgtttagcccctggtgagtgggggacatgatggatggagctggaccaggcgagtctgcctacaggctccagggacaagcacaagtgctgagggagaatccagtgagcagccatcaagtacctagaggtgcacctaggcatggagctgggaaacctctttagccccaagttcactgcacagggatgggggatggcctaaactccttatccaggagagggggcactccaggtgcctggagatctgcctgggtgtggagtgaagaggtccctgcttcaccaggatctctatataggaagaatggcataggtcagaatgccaatccaggtgagtgggtactttgaatacctggagatctgcctattgtggagcagagaaagccccgtttcaccacaatctatactcaggaaggttgaggtggctcaagctgctgaactaagcaaatgggtcctccaaatgcctggagatctgcctgggcatggagcagaaaaggccccactatatcttgatctatgtctatgaagggtggggcagctcaggctgctggtccaggcaaacaggtactccaaatgcctggatttctgcctgtggctagagtggatagggccccactgcaccatgatctcaggggaacaggatggagcacccagaaatggcgtgcacagactggttccaagtcactaagctgaccctggctgcaagtcttgctgctcaggagaaactgcagtggtagcagctcccatcccatcctagtcttgcaatggggaataacaaaattccagtgcctactgctgaggtacttttcatagttctagctctggagacccctatgccactctagagcaggcactccagtctctgacctgagactaaaatgcctgcatggctacactgccaggttgctaaagaatggctgactttatgtccctgggttaaaacacatcctgcttttggtcccaggtctgggaaaatgcctgtagtgttccccagtgtcttttttctcatagcatctccaagctcctccccaggttggctgcaaggcttaggataaacaaggtgtcctcccttggcctgggttgctcggatccccagtggaaaggtaagtaacagagggaggctgtctgcctgtctcacatactggggtttcactcacttttctcagccagatgctttcatggggtccgtttgcccacattttcctctctgggatctgaggtgtccttcatgattctggtgaatccccattttccttcttgaattaatgccacagagttgatctttatgcactatcttgctatttccaagtgactgaggcatgctaaaagggtgtaatccaccatcttgtgaaaaaaagcgtgttaatcttattgtgggtcttgggtgaagaattgtttttttcttgctacatttagagttttctctttatcctttgtttgattttgatgtgcctaggtgtggatctgtttcagtttatcctacttagagattgttgagcttcttggatgttgagcttcttggacatgaagattaatgtttttcatcaaatgtaagttttcagtcattattcacatttttttctgctcctttgccttttttctctaagtatgtcacctttgtgtagcagaaaaagaaaaggcatacatgactggattaggggcctcatcacatgtcaggggccagctctgcaagtcttgtactttggaaaaagaaccaactagcctgttcagcgatacaaatgtcagaaagttgagaatgcctggatttcaaatatcctaatagactatagaggagatatgtttggtgaaggaaatcctttccggaatcctccaagtcataatgtaaatggttgcctactaattctcagcccttaaatctagtcctagtaagccctgataaactgactcatacaagatgggaatgcctaccatgaaatgctgagatgggatatgacagtgacaacaaaggctgctgctgtaatgtgatctctccagatgggttctttcatcttaggtaaaaaggtcagtcctatgatcgtttgcaaacactgcaatggttgactttattataaggattatgatctaagtgatgtaatggcaaaaatcctttcctaatcctgtattgagtcaacaactgttctctatttgctttgatacagttcagtgtgagggggtagtttatagaatcctgaatttcaacaacaataattgctatatttacggtgcagctgttgaactgttaatccttctttatgatggtgttacagaattgaattatattaaattactctgaatacagcaggcatgacttttcatttgtctgtactatattaaagattatgtatttttaaatcttgataacactcaacctttgagttacaaaccagatagtttcatgaaaaatcatgaaactttaaaatatagtaaataatataacccacaagtaatttttgtcagtttttaaaatatttctttcagaacctttataatcccttaatgataagtgatacctgcacatgaatgctgcctttgaaaggggttcagtgttatttaaaaaataacagcatgcatgtttttcttcccctactaaatttaaatcaacgtactctcaaagctgagaggatgaagtgaagaatagtgggtgggtgaggagaattaaaaataagtactgtaaaaatccaatggtgcctgaaaggatttaagacaaaaatgtgagagcgcatgaggtagtaggattacgttgtgccaaaggaaataacaagactgcatatttgttatttcaggaaagatagcacaatagcaggattacttttatcatccacgttgaagtcacaggccttccccactcaccactgcttaccacacctacaaccctcttctaaaaaagccacggaagccggatgtctttttcgggtattgggcagaactgccctgcataggaacaccacatgggatggtgacaaatttgtcaatttgatcctctttcttaataataaatatggattttgagatatacacataaatggaagttacactccaatattttctgagatatgtgcagtgttccatgagctctgaggtgtagccaaatctttgagaccaagagtgactgtattagtccattttcatgctgctgataaagatatacccaagactgggaagaaaagaggtttaattggacttacagttccacctggctggggaggccttagaatcatggtgggaggcgaaaggccattcctacctggtgactgcaagagaaaatgagagagaagcaaaagcggaaacccctgataaacccatcagatctcgtcagacttattcactatcatgagaatagcacgagaaaggccagcccccatgatttaattacctccccctgggtccctcccacaacatgtgggagttctgggcggtacaattcaaatttatattggtggggacacagtcagaccatatcagtgactgtctagccagaagggagatggatgacttgagacttaatatgctcttgaatttttgtgagatatccttgcactgaaagtaactgggcatgtctcttgtaatcctgaaaagccattttatacatcagacactgggcctcgacttctgggtctctgtcttgtgttatatgtttcttttcatgccagagagaagaaattgcagaacgaacaaagaaaacagactttggagttctcaagacttagattcagattgactcttgctgctgagctgaatgtcagccactgtcagatcatttagtttagataaaaatgaattggcctgtcctgtctactttagagttcctaagagggttcaataaaatcataatgtatcaagtacaccaatataatctggatatttgtccccacccaaatctcatgttgaaatgtaatccccaatgctggagccagggcctggtgggaggtgtttgggtcatgggggcagatgcctcatggcttggtgctatccttgtgatagtgagtgagtttttgtgagatctggtcatgtaaaagtgtatggcacccctcaccccccctctctctcccttgctccccctcttgctatgtgatgtgtctgctcctgcattgtcttctgccacaggtaaaagctccctgaggcctcccagaaactgagcagatgctggcaccttgcttcctatgcagcctgcagaactgtgagccaattaaatctcttttctttgtaaattacccagtctcaggtatttctttatagcaaagcaagaatggactaatacacatactaagattttgaaagtagttaatgactttacaaatgttattgattatgtttcatctcttacctaatcaagtgtctctagtattgtcttttatatatttttgtctcccctgtgtggccagtaaaatgtaggagcccaagaaagtgtttaatatgtgtttgttgcacttatgatcatcttgaagtcaagacttttatggttcattcagcagtggggccatattcaaagaatagtacaaacaggaattcagatcatatacaaatcaaatgtagaacttgaagacaagttttactaagatctcctttttctcatattctgtagcatctggcaaccctgaggcctgtcactctccttccacagaaggaccctctctcactctccttggcccacacccggtctctctccagcccactcctcatccagctctaaccgacttctcccagctctgccctgggctctccatagtctgcaggtgtaggatccttcttcactcaatgcctgctgggaagagaagcccctctttaccctcactgccagtttcacaagaataggtcattcattcctcagtgccttttcctcattctgcctcccaagaaccttaatcttgttcagaaggagaagaggggaaggaactaaacagttttcagaatcagaacctgatttatcagggttaagggttgggaaaacttataataataaatccatatttattattaagaaagaggatcaaattgaccaatttgtcaccatcccatgtggagttcctatgcagggcagttctgcccaataccccacaaagacagggaaaagggttgggaaaacttacctgtatgtttgtcatttttatcttatcccatagaatgattggatgcagaataataaagccagcaagtatgtattatgttcctattgggaagctggttctaggaatgagctgaaaggagtaaactacagccctgcccttaaagacttcgtgctggggaattttcacagtgcttagcacgtgaggctgggctactccagaaacccttgtagatgctgcagagagtgaaggatactgtagcactttaaaaatattgcagaataatttacttaaaatgaattctcctttttaagcgtatagttcaatgagttctggcaaatgtatcgtcatctaaccatcattactctcaagatacagaaatgtccatcacccccaagagttcctgtatactccttttcagtcattcccatccattaccaccactgcctgccaaccactagtctgttttctatgcttatagcactgtcttttctagaatgctatatagatggaatgtggaatatgtatatttttgcatacatgtgttagtaattcattctttttattgctgaggaatattccattgtacatatatagcattatttggttatctgttctccagttgggtatttgggttgtttcctatttttgactactcaatatagctgctatgaacgttcatgtagaggcctctgtgtaaacataggtatttgtttcttttgtgtaaacacctaggatttggattggtgtgttgtatggtagatgcattattacttttactagaaacttccatactgttttccaacgtgactgtatgagggtctagttgctccgtatccttgccaacacttggtgttgtcgatcattttgattttgtattgtattggtatgtagaggtaccttgcagtttcagtttgcattttcctgatgagtaatgattttgagcatcttttcacatgcttgctggccatttgtatatcgtctctgatgaggtgtccagatcttttgctcatttttcactaggttgtttgtcttaatatgagttgtatttttattattgagtcgttattattgggtaagagttttaaatatatattcaagatacaagctctttttttgtgtttggaaatatttttacctagtctaactgatttgtcttttcattttttttttttttacaaatatacaattttattctaagggaatatttctgtagtttctgcaaggggaaaacctaaaagaggttaaaaactgaaaaagaacagaaaggatgatttagatgtttctctttttgtttgatgtttttttctcccctggaaaaaaatgtaattttacacaattttcgtaaaattaaaaaagtaataatcagatgcacacatcaacagctacacttatgaggaatgaccaataattaatcaatattttctcttatgaataaatgtaggattctgggcaactctgtggactaacaagcaaatgaaatcctgatacagtcatttatctgtatgattaattccatctgtggttgtcatttctgactggaaaacttttcattttcttaagagtgtttttcaaatagtagtagtgtttaattttgatgatgaccagtttaacaattttcttcttttgtagtttgtgctttttatagtttgggagaaatctttgcgtaacacaaggtcaatgtgttatgggttgaattgtattccccctgccccccaattaatatgttgaagccctaacccccaataagccctaaggtaaggtaaggtaaaccctaccttagaatgtgaccttgtttggaaatagggtcttcacagagatgatcaagttaaaatggggttattgggggtgggttctaatccaataggactggtgtccttatgtaaagggtatatctgaggacagatacacacacagggagaatgccatgtaaacataaaagcagagttggggtgataatttacaagctgaggaatgccaaaagtgccaggagagtactagagaaggagagaagcatggaacagattctctctcacagcgctcagagggaacagccctgctgacactttgaccttggactttcagcccccagaactgtgagataatacatttctgtggtttaagtcctcagtttgtggtacttaattctagcagccttagcaaatagtcaccaaaccactaagattttctttttttttttttctagaagtcctgtggtactttttttttgtatttatctgcatttattttattattattatttttaaattttattattatcatactttaagttttcaggtacatgtgcacaatgtgcaggtttgttacatatgtatacacgtgccatgttggtgtgctgcacccattaactcatcatttagcattaggtatatctcctaatgctatccctccccctccccccaccccacaacagtccccggagtgtgatgttccccttcctgtgtccatgtgttctcattgttcaattcccatctatgagtgagaacatgcggtgtttggttttttgtccttgcgatagtttgctgagaatgatggtttccagtttcatccatgtccctacaaaggacgtgaacttatcattttttatggctgcatagtattccatggtgtatatgtgccacattttcttaatccagtctatcattgatggacatttggcttggttccaagtctttgctattgtgaatagtgccacagtaaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctctacatcctctccagcacctgttgtttcctgactttttaatgattgccattctaattggtgtgagatggtatctcattgtggttttgatttgcatttctctgatggccagtgatgatgagcattttttcatgtgttttttgtctgcataaatgtcttcttttgagaagtgtttgttcatctcctttgcccactttttgatggggttgtttgtttgtttcttgtaaatttgtttgagttcattgtagattctggatattagccctttgtcagatgagtaggctgcgaaaattttctcccattttgtaggttgcctcttcactctgatggtagtttcttttgctgtgcagaagctctttagttgaattagaatccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttcctcattgcttgtttttgtcaggtttgtcaaagatcagatggttgtagatatgcggcattatttctgagggctctgttctgttccattgatctgtatctctgttttggtaccagtaccatgctgttttggttactgtagccttgtagtatagtttgaagtcaggtagcgtgatgcctccagctttgttcttttggcttaggattgacttggtgatgcgggctctttttttggttccatatgaactttaaagtagttttttccaattctgtgaagaaagtcattggtagcttgatggggatggcattgaatctataaattaccttgggcaatatgtccattttcacgatattgattcttcctacccatgagcatggaatgttcttccatttgtttgtatccttttttatttcattgagcactggtttgcagttctccttgaagaggtccttcacatcccttgtaagttggattcctaggtattttattctctttgaagcaattgtgaatgggagttcactcatgatttggccctctgtttgtctgttattggtgtataagaatgcttgtgatttttgtacattgattttgtatcctgagactttgttgaagttgcctatcagcttaaggagattttggactgagacaatggggttttctagatatacaatcatgtcatctgcaaacagggacaacttgacttcctcttttcctaattgaatacccttcatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgagatacatctattgatacctagtttattgacagtttttagcatgaagggctgttgaattttgtcgaaggccttttctgcatctattgagataatcatgtggtttttgtctttggttctgtttatatgctggattacatttattgatttgcgtatgttgaaccagccttgcatcccagggatgaagcccacttgagcatggtggataagctttttgatgtgctgctggattcggtttgccaatattttattgaggatttttgcatcaatgttcatcaaggatattggtctaaaattctcttttttggttttgtctctgccaggctttggtatcatgatgatgctggcctcataaaatgaattagggaggattccctctttttctattgattggaatagtttcagaaggaatggtaccagctcctccttgtacctctggtagaattcggctgtgaatccatctggtcctggactttttttggttggtaagctattgattattgcctcaatttcagagcctgttattggtctattcagagatttgacttcttcctggtttagtcttgggaaggtgtatgtgtcgaggaatttatccatttcttctagattttctagtttatttgcgtagaggtgtttgtagtattctctggtggtagtttgtatttctgtgggatcggtggtgatatcccctttatcattttttattgcgtctatttgattcttctctcttttcttctgtattagtcttgctagcggtctatcaattttgttgatcttttcaaaaaaccagctcctggattcatgaatttttgaagggtttttttgtgtctctatgtcctttagttctgctctgatttttgttatttcttgccttctgctagcttttgaatgtgtttgctcttgcttttctagttcttttaattgtgatgttagggtgtcaattttggatctttcctgctttctcttgtgggcatttagtgctataaatttccctttatacactgctttgaatggatcccagagattctggtatgttgtatctttgttctcattggtttcaaagaacatctttatttctgccttcatttcattaggtacccagtagtcactcaggagcaggttgttcagtttccatgtagtggagcggttttgagtgggtttcttaatcctgagttctagtttgattgcactgtggtctgagagacagtttgttataatttctgttcttttacatttgctgaggagtgctttacttccaactatgtggtcagttttggaataggtgtgatgtggtgctgaaaaaaatgtatattctgttgatttggggtggagagttctgtagatgtctattaggtctgcttggtgcagagctgagttcaattcctggatatccttgttaactttctgtcttgttgatctgtctaatgatgacagtggagtgttaaagtcttcaattattattgtgtggaagtcaaagtctctttgtaggtcactaaggacttgctttatgaatctggatgctcctttattgggtgcatatgtatttaggatagttagttcttcttgttgaattgatccctttaccattatgtaatggccttctttgtctcttttgatctttgttggtttaaagtctgttttatcagagactaggattgcaacccctgcctttttttgttttccatttgcttggtagatcttcctgcatccctttattttgagcctatgtgtgtctccgcatgtgagatgggtttcctgaatacagcacactgatgggtcttgagtctttatccaatttgccagtctgtgtcttttaattggagcatttagcccatttacatttaaagttaacattattatgtgtgaatttggtcctgtcattatgatgatagctggtcattttgctcgttagttgatgcagtttcttcctagccttgatggtctttacattttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttatagagtttctgccgagagatctgctgttagtctgatgggcttccctttgtgggtaacccgacctttctctctggctgcccttaacattttttccttcatttcaactttggtgaatctgacaattatgtgtctgggagttgctcttctcgaggagtatctttgtggcgttctctgtatttcctgaatctgaatgttggcctgccttgctagattggggaagttctcctgcataatatcctgcagagtgttttccaacttggttccattctccccatcactttcaggtacaccaatgagacgtagatttggtcttttcacatagtcccatatttcttggaggctttgctcatttctttttattctcttttctctaaacttcccttctcctttcatttcattcattttgtcttccatcactgataccctttcttccagttgatcgcatcagctcctgaggcttgtgcattcgtcacatagttctcgaaccttggctttcagctccatcagctcctttaaggacttctctgcattggttattctagttatccattcgtctaattttttttcaaagtttttaacttctttgccattggtttgaatttcctcctgtagctcagagtagtttgatcgtctgaagccttcttctctcaactcgtcaaagtcattctccgtccagctttgttctgttactggtgaggagctgtgttcctttggaggaagagaggtgctctgctttctagggtttcctgtttttctgctctgttttttccccatctttgtggttttatctacttttggtctttgatgatggtgacatacagatgggtttttggtgtggatgtcctttctgtttgttagttttccttctaagagacaggacccttagctgcaggtctgttggagtttgctagaggtccactccagaccctgtttgcctgggtatcagcagcggtgtttgcagaacagtggtttttcgtgaaccgcaaatgctgctgtctgatcgttcctctggaagttttgtctcagaggagtacccggccgtgtgaagtgtcagtctgcccctactggggggtgcctcccagttaggctgcttaggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgcgctgcccccagaggtggagcctacagaggcaggcaggcctccttgagctatgttgggctccacccagttcgagcttcccagctgctttgtttacctaagcaagcctgggcaatggcgggcgcccctcccccagcctggctgccgctttgcagtttgatctcagactgctatgctagcaattagggagactccgtgggcgtaggaccctctgtgccatgtgcgggatataatctcctggtgtgccgttttttaagcccgttggaaaagcgcagtattagggtgggagtgacccgattttccaggtgcagtctgtcacccctttctttgactaggaaagggaactccctgaccccttgaacttcccgagtgaggcaatgcctcatcctgcttcggctcacgcacggtgcgctgcacccactgtcctgcacccactgtctggcactccctagtgagatgaacctggtacctcagatggaaatgcagaaatcacccatcttctgcgtcgctcacgctgggagctgtagatcggagctgttcctatttggccatcttggctccaccct

SEQ ID NO: 12793 - DNA, 6918 bp, Homo sapiens
tttatttatttatttatttatttttttttttaattttttttttaaattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttccagtgtccatgtgatctcattgttcaattcccacctatgagtgagaatatgaggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacttttgggttggttccaagtctttgctatcgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttcagaagtgtctgttcatgtccttcgcccactttttgatggggttgtttgtttttttcttgtaagtttgtttgagttcattgtagattctggatattagctctttgtcagatgagtaggttgcaaaattttctcccatgttgtaggttgcctgttcactctgatggtagtttcttttgctgtgcagaagttctttagtttaattagatcccatttgtcaattttggcttttgttgccattgcttttggcgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggagtcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgcatcctcttttatttccttgagcagtggtttgtagttctccttgaagaggtccttcacatcccttgtaagttggattcctaggtattttattctctttgaagcaattgtgaatgggacttcactcgtgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagggcatccctgtcttctgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggggaactattgattattgccacaatttcagagcctgttattggtgtattcagagattcaacttcttcctgggtttaatcttgggagagtgtatgtgtcgaggaatgtatccatttcttctaaattttctagtttatttgcatagaggtgtttgtagtattctctgatggtagtttgtatttctgtgggatcggtggtgatatcccctttaccattttttattgtgtctatttgattcttctctctttttttctttattagtcttgctagcggtctatcaattttgttgatcctttccaaaaaccagctcctggattcattgattttttgaagtgttttttgtgtctctattttcttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcagattgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaagtccgcttggtgcagagctgagttcaattcctgggtatccttgttgactttctgtctcgttgatctgtctaatgttgacagtgggatgttaaagactcccattattaatgtgtgggagtctaagtctctttgtaggtcactcaggacttgctttatgaatcggggtgctcctgtattgggtgcataaatatttaggatagttagctcctcttgttgaattgattcctttaccatgacgtaatggccttctttgtctcttttgatctttgttggtttaaagtctgttttatcagagactaggattgcaacccctgcctttttttgttttccattggcttggtagatcttcctccatccttttatttcgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtggttttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctggtttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggcttttctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcacagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcaggtctccagctgcatgctgggagaaccactgctctcttcaaagctgtcagacagggacacttaagtctgcagaggttactgctgtctttttgtttgtctgtgccctgcccccagaggtggagcctacagaggcaggcaggcctccttgagctatggtgggctccacccagttcgagcttcccggctgctttatttacctaagcaagcctgggcaatggcgggcgcccctcccccagcctcgttgccgccttgcagtttgatctcagactgctgtgccagcaatcagcgagattccgtgggcataggaccctctgagccaggtgtgggatatagtctcctggtgcgccgttttttaagccggtctgaaaagcgcaatattcgggtgggagtgacccgattttccaggtgcatccgtcacccctttctttgactcggaaagggaactccctgaccccttgcgcttcccaggtgagggaatgcctcgccctgcttcggctcgcgcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccacagacattttttatttcaaaaacattagtagacatttttctatgttgaaaaaccatctgaaatttgtatagaacaataaaagactctgaatagtcaaagcaatcttgatcaaaaagaacaaagctagaggcattatacaactgacttcacaatacagtaaccaaaacagcatggtattggaataaaaacagccatataggctaatgaaacagaatacaaagcctagaaataaatctatgaatttacagtcaactgattttcaacatatgtatcaaaaacacatcttgagaaaaggacagtttcttcaataaatggggtcaggaaaactggatatccatgcacataaaaatgaaattagacccttatctctcaccacatacaaaaatcaactcaaaattgacagagacttaaatgtaagaccaaaactgtgaaacaattagaagaaaacatagggaaagtgcttcatgacattggtgtaggcaaggattttatggaaagccctgtaaagtatagacaacaaaagcggtgatagacaaatagaattacatcgaactaaaaagcatctgcacatcacaggaaacaatcaacagagtgaagagacaacccacagaatgggagaaaatatttgcaaactacacatccaacaaggggttaatatccaaaacagggaaataattcaaataactcaaaaaaaaaaaaaaagaaatgggcaaaagatctgcatggacatttctctgaagaagacatacaaatgggcaacaggtatacaaaataatactcaacatcactaatcatcagggaaatgcaaatcaaaaccacaataaaatatctcaccacagttagaaggatataatcaaa

SEQ ID NO: 12794 - DNA, 6078 bp, Homo sapiens
  misc_feature (100)..(100): n equals a,t,g, or c
  misc_feature (137)..(137): n equals a,t,g, or c
  misc_feature (142)..(142): n equals a,t,g, or c
  misc_feature (148)..(148): n equals a,t,g, or c
  misc_feature (151)..(151): n equals a,t,g, or c
ttatttttatttatttatttatttatttatttatttttaactttgtaaattttttttattatactttaagttttagggtacatgtgcacattgtgcaggntagttacatatggatacatgtgccatgctggtgcatngcacncactanctngtcatgtagcattagggatatcctccaatggctatcccttcccccctccccccaccccaccacagtccccagagtgtgatatttcccttcctgtgtccatgtgatctcattgttcaattcccacctatgagtgagaatacgcggtgtttggttttttgttcttgcggtagtttactgagaaagatgatttccaatttcatccatgtccctacaaaggacatgaactcatcattttttatggctgcatagtgttccatggtgtacatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaaggtttaaggctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaaatagttttttccaattctgtgaagaaagtcattggtagctttatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgcgagttcactcatgatttggctctctgtttgtctgttattggtgtataagaatgcctgtgatttttgtacattgattttgtatcctgagactttgctgaagttgcttatcagcttaaggagatttggggctgagacaatggggttttctagatatgcaatcatgtcgtctgcaaacagggacaatttgacttcctcttttcctaattgaataccctttatttccttctccagcctaattgccctggccagaactgccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttcttgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgggagactgtatgtgtcgaggaatttatccatttcttctagattttctagtttatttgcgtagaggtgtttgtactattctctgatggtagtttgtatttctgtgggattggtgctgatatcccctttatcattttttattgtgtctatttgattcttctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgttcgctcttgcttttctagttcttttaatggtgatgttagggtgtcaatgttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtatccagtagtcattcaggagcaggttgttcagtttccatgtagttgagaggttttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctgccattattaatgtgtgggagtctaagtctctttgtgggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgcttgttagttgatgcagtttcttcctagtctcggtggtctttacattttggcatgattttgcaacggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcttatggcttgtagggtttctgccgagagatctgctgttagtctgatgggcttccctttgagggtaacccgacctttctctcaggctgcccttaacattttttccttcatttcaactttggtgaatctgacaattatgtgtcttggagttgctcttctcgaggagtatctttgtggcattctctgtatttcctgaatctgaacattggcctgccttgctagattggggaagttctcctggataatatcctgcagagtgttttccaacttggttccattctccccatcactttcaggtataccaatcagacgtagatttggtcttttcacatagtcccatatttcttggaggctttgctcatttctttttattcttttttctctaaacttcccttctcgcttcatttcattcatttcatcttccattgctgatactctttcttccagttgatcgcatcggctcctgaggcttctgcattcttcacctagttcttgagccttggttttcagctccattagctcctttaagcacttctctgtattggttattctagttatacgttcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtgaatgtcctttctgtttgttagttttccttctaacagacaggaccctcagctgcaggtctgttggaataccctgccttgtgagttgtcagtgtgcccctgctggggggtgcctcccagttaggctgctcgggggtcaggggtcagggacccacttgaggaggcagtctgcccattctcagatctccagctgcgtgctgggagaaccgctgctctcttcaaagctgtcagacagggacatttaagtctgcagaggttactgctgtctttttgtttgtctgtgccctgcccgcagaggtggagcctacagaggcaggcaggcctccttgagctgtggtgggctccacccagtttgagcttcctggctgctttgtttacctaagaaagcctgggcaatggcgggcgcccctcccccagcctcgctgccgccttgcagtttgatctcagactgctgtgctagcaatcagcgagactccgtgggcgtaggaccctccgagccaggtgcggaatataatctcgtggtgcgccgttttttaagccggtctgaaaagcgcaatattcgggtgggagtgacccgattttccaggtgcgtccgtcacccctttctttgactcagaaagggaactccctgaccccttgcgcttcccaagtgaggcaatgcctcgccctgcttcggctcgcgcacggtgcacgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcctcctcctcta

SEQ ID NO: 12795 - DNA, 6070 bp, Homo sapiens
ttatatttctttttttttttttggccaatttactttcttttttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacgtatgagtgagaatatgcagtgtttggttttttgttcttgtgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgctgtttcctgactttttaatgattgccattctaactggtgtgagatggtatctcattgcggttttgatttgcatttctctgatggccagcgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggtttccttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccagatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgctgttgtataagaatgcttgtgatttttgtacattgattttgtatcctgagactttgctgaagttgctgatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctagattacatttattgatttgcatatattgaaccagccttgcatcccagggatgaagcccacttgatcatggtggataagctttttgatgtgctgctggattcggtttgtcagtattttattgaggatttttgcatcaatgttcatcaaggatattggtctaaaattctcttttttggttgtgtctctgcctggctttggtatcagaatgatgctggcctcacaaaatgagttagggaggattccctctttttctattgattagaatagtttcagaaggaatggtaccagttcctccttgtacctctggtagaattcagctgtgaatccatctgctcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtcgtgatatcccctttagcattttttattgcgtctattagattcttctctctttttttctttattagtcttgctagcagtctatcaattttgttgatcctttcataaaaccagctcctggattcatttattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagatatagtttgttataatttgtgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtgttgggtgcatatatattcaggatagttagctcttcttgttgaattgatccctttaccattatgtaatggctgtctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaacacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcattagttgatgcagtttcttctgagtcttgatggtctttacattttggcatgattttgcagcggctggtaccggttgttcctttccatgtttagcgcttccttcaggagctcttttagggcaggcctggtggtgacaaactctctcagcatttgcttgtctgtaaagtattttatttctcctttgcttatgaagcttagtttggctggatatgaaattctgggttgaaaattcttgtctttaagaatgttgaatattggcccccactctcttctggcttgtagggtttctgccgataaatctgctgttagtctgatgggcttccctttgagggtaacccgacctttctctctggctgcccttaacattttttccttcatttcaactttggtgaatctgaaaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccatcgctgatatcctttcttccagttgatggcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccgtccagctttgttccattgctggtgaggaactgcattcctttggaggaggagaggcgctctgctttttagagtttccagtttttctgttctgttttttccccatccttgtggttttatctacttttggtctttgatgatggtgatgtacagatgggtttttggtgtggatgtcctttctgtttgttagttttccttgtaacagacaggaccctcagctgcaggtctgttggagtaccctgccatgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaagcctccttgagctgtggtgggctccgcccagttggagcttcgaggctgctttgtttacctcagcaagcctgggcaatggcgggcgcccctcccccagcctcgctgccaccttgcagtttgatctcagactgctgtgctagcaatcagcgagactccgtgggcgtaggaccctccgagccaggtgcggggtataatctcgtggtgcgccgttttttaagcccgtcggaaaagcgcagtattcgggtgggagtgacccgattttccaggtgccgtcagtcacccctttctttgactcggaaagggaactccctgaccccttgcgcttcccaagtgaggcaatgcctctccctgcttcggctcgcgcacggtgcgcgcacccactgacctgcgcctgctgtctggcactccctagtgagatgaacccggtacctcagatggaaatgcagaaatcaccgtcttctgcgtcgctcatgctgggagctgtagaccggagccgttcctattcggccatcttggctcctccaggccc

SEQ ID NO: 12796 - DNA, 6006 bp, Homo sapiens
cctttgtcagatggatagattgcaaaaatattcttccattctgtaggttgtctgttcactctgatgatagtttgttttgctgtgtagaagctctatggtttaatcagatccaatttgtcaatttttgcttttgttgtaactgcaaaaattgacaaattggatttcatgatgaaatctttgcctgtgcctgtgtcctaaatggtaatgcctagattttctactagggtttttatagttttgggttttacatataagtctgtaatccatcttgagttaatttttgtataaggtttaaggaaggggtccagtttcaattttctgcatatggctagccagttttcctagcaccatttattaaatagggaattctttccccattgtttgtttttgtcgggtttgacaaagatcaggtggttgtaggagtgtggtcttatttgtgagttctctattttgttccattggtctatgtgtctctttctgtacctgtaccatggtgttttggttactatagccttgcagtatagtttgaagtcaggtagtgtgatgactctggcttttttttttttttttttgcttaggattgtcttagctcctttttggttttatgtcagtttagaaattgtttttttttaaaattctgtgaagaatgtcaatgtttgtttaatgggaatagcattgaacctgtaaattactttgggcagtatggccattttcatgatattgattcttcccatccgtgagcatggaatgttatttcatttgtttgtgtcttctcttatttccttgaacagtggtttgtagttctaattgaagaagtcattcacttcccttataggctgtattcctaggtattttattctctgtgcagcaattgtgaatgggagttcattcatgatttggctttttgcttgtctgttgttgatgtataggaatgcttgtgatttttgcacattgattttgtatcctgagactttactgaagtttcttatcagcttaagaagctttagaactgagacaataggattttctagatatacgatgatgtcatctgcatagataacttgactttttcctctttctatttggatatgtttttttttttaacattgagataacttttattttttattttttattttttatttttttttaccttttttcattttattattattattattatttttcattatactttaagttctagggtacatgtgcacaacttgcaggtttgtcacatacgtatacatgtgccatgttggtgtgctgcacccattaactcgtcatttacattaggtatatctcctaatgctctccctcccccctccccccaccccacagcaggccccagtgtgtgatgtcccccttcctgtgtccatgtgttctcattgttcaattcccacctaggaatgagaacatgagatgtttagttttttgcccttgcgatggtttactgagaatgatggtttccagcttcatccatgtccctacaaaggacatgaactcatcattttttatggctagatagtattccatggtgtatatctgccattttcttaatccggtctatacattgttggacatttatgttggttccaagtctttgctattgtgaatagtgccgcagtaaacgtaagtgtgcatgtgtcttcatagcagcatgatttataatcctttgggtatatacccagtaatgggatggctgggtcaaatggtatttctagttctagatccctgaggaatcggcacactgtcttccacaatggttgaaccagtttacagtcccaccaacagtgtaaaagtgttcctatttctccacatcctctccagcacctgttgtttcctgactttttaatgatcgccattctaactggtgtgagatgctatctcattgtggttttgatttgcatttctctgatggccagtgatgatgagcattttttcatgtgtctgttggctgcataaatgtcttcttttgagaagtgtctgttcatatcctttgcctgcttgttgatggggttgtttgtttttttcttgtaaatttgtttgagttctttgtagattctgggtattagccctttgtcagatgagtagattgcaaaaattttctcccattttgtaggttgcctgttcactctgatggtagtttcttttgctgtgcagaagctctttagtttaattagatcccatttgtcaattttggctttggttgccattgcttttggtgttttagacatgaagtccttgcccatacctatgccctgaatggtattgcttaggttttcttctagggtttttatggttttaggtctaacgtttaagtctttaatccatcttgaattaatttttgtataaggtgtaaggaagggatccagtttcagctttctacatatggctagccagctttcccagcaccatttgttaaatagggaatcctttccccatttcttgtttttgtcaggtttgtcaaagatcagatagttgtagacgtgtggcattatttctgagggctctgttctgttccattggtctatatatttgttttggtaccagtatcatgctgttttggttactgtagccttgtagtatagtttgaagttaggaagtgtgatgcctccagctttgttcttttggcttaggattgacttggcaatgcgggctcttttttggttccatgtgaactttaaagtagttttttccaattctgtgaagaaagtcattggtagcttcatggggatggtattgaatctataaattaccttgggcagtatggccattttcacgatatttattcttcatatccatgagcatggagtgttcttcaatttgtttgtgtcctcttttattttattgagcaatgatttgtagttctccttgaagagatcctttacatcccttgtatgttggattcctaggtattttattctctttgaagcaattgtgaatgggagttcacacatgatttggatctctgtttgtctgttattggtgtataagaatgcttgtgatttttgcacattgattttgtatcctgagactttgctgaagttgcttatcagcttaaggagatttggggctgagatgatgaggttttctaaatatacaatcatgtcatctgcaaacagggacaatttgacttcctcttttcctaattgaataccctttatttctttctcttgcctgattgccctggccagaacttccagcactatgttgaataggagtggtgagagagggcatccctgtcttgtgccagtttcaaagggaatgcttccagtttttgcccattcagtatgatatttgctgtgggtttgtcatggatagctgttattattttgagatacgtcccatcaatacctaatttattgagaatttttagcatgaagcgctgttgaattttgtcaaaggccttttctgcatctattgagataatcatgtggtttttgtcgttggttctgtttatatgctggtttacatttattgatttgcgtatgttgaactggccttgcatcccagggatgaagcccacttgatcatggtggagaagctttttgatgtgctgctggattcggtttgccagtattttattgaggatttttgcataaatgttcatcacggatattggtctaaaattctcttttttggttgtgtctctgccaggctttggtatcatgatgatgctggcctcataaaatgagttagggaggattccctctttttctattgattggaatagtttcagaaggaatggtaccagctcctccttgtacctctggtagaattcggctatgaatccatctggtcttggcctttttttggttggtaagctgttaattattgcctcaatttcagagcctgttattggtctattcagagattcaacttcttcctggtttagtcttgggagagtgtatgtgttgaggaatttatccatttcttctagattttctagtttatttgcatagaggtgtttatagtattctctgatggtagtttgtatttctgtgggatcggtggtgatatcccctgtatcattttttgttgcatctatttgattcttctctcttttcttctttattagtcttgctagcggtctatcaattttgttgatcgtttcaaaaaaccagctcctggattcattgattttttgaagggttttgtgtttctctatctcctccagttctgctctgatcttagttatttcttgccttctgccagcttttgaatgtatttgctcttgcttctctagttcttttaattgtgatgttagggtgtcaattttagatctttcctgctttctcttgtgggcattcaatgctgtaaatttccctctacacattgctttaaatgtgacccagagattttggtatgttgtgtctttgttcttgttggtttcaaagaacatctttatttctgccttcatttcattatgtacccagtagtcattcaggagcaggttgttcagtttccatgtagttgagcagttttgagtgagtttcttaatcctgagttctaatttgattgcactgtggtctgagagacagtttgttataatttctgttcttttacatttgctgaggagtgctttacttccaactgtgtggtcaattttggagtaagtgcggtgtggtgctgagaagaatgtatattctgttgatttggggtggagagttctgtagatgtctattaggtccacttggtgcagagctgaaatcaattcctggatatcctcgttaactttctgtctcgttgatctgtccaatgttgacagtggggtgttaaggtctcccattattattgtgtgggaatctaagtctgtttgtaggcctctaaggacttgctttatgaatctgggtgctcctgtattgggtgcatgtatatttaagatagttggctcttcttgttgaattgatccctttaccattatgtaatggccttctttgtctcttttgatctttgttggtttaaagtctgttttatctgagactgggattgcaacccctgcctttttttgttttccatttgcttggtagatcttcctccatccctttattttgagcctatgtgtgtctctgcacatgagttgggtctcctgaatacagcacactgatgggtcttgactctttatccaatttgccagtctgtgtcttttaattggagctttcagcccatttacatttaaggttaatattgttatgtgtgaatttgatcctgtcattatgatgttagctggttattttgctcattagttgatgcagtttcttccttgcattgatggtctttacaatttggcatgtttttgcagtggctggtaccagttgttcctttccttgtttagtgctttcttcaggagctcttgtagggcaggcatgatggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgctgagagatccactgttagtctgatgggcttccctttgtgggtgacccaacctttatctctggctgcccttaataatttttccttcatttcaactttggtgaatgtgacaattatgtgtcttggagttgctcttcttgtggagtatgtttgtggcattctctgtatttcctgaatcagaatgttggcctgccttgctaggttggggcaattctcctggataatatctcgcagagtgttttccaacttggttccattctccccatcactttcaggtacaccaatcagacgtagatttggtcttttcacatagtcccatatttcttcgaggctttgtttatttgtttttattcttttttctgtaaacttctgttcttgcttcatttcattcatttgatcttcaatcactgataccctttcttccacttgattgagtctgctactgaggcttgtgcattcatcacgtcgttctc

SEQ ID NO: 12797 - DNA, 5966 bp, Homo sapiens; identical to SEQ ID NO: 12652

SEQ ID NO: 12798 - DNA, 9478 bp, Homo sapiens
tcccaaagttctggcattacaggcgtgagccaccacgcccggcccctagtttacttttaagtggaaagatgagaaggggccatcagacaaggtgatgtgtctggcaacaagtgaagagatcatagatttcatttccacagataagtcaatacagttatttaggaaatgagaaatctctgactctggtctttgtgtaatattctatgatagcagaaacaaaaaattgaattgtgcctattgttaaaagtttactttgtttatgatttctactgtatgaaattatatgatctgggttatattaacacccagtgaaaccaaggggctgggttggtacactgaaagttattataatataattctcatgtgaggctaattgttactatatttgtttttaatttgactagaaatcccaatatttaatcaaaagtcttctcctctacctagagcttgttttatcgttttggtggcctcctcttgcaaaggactggctggtgaatggtttccctgaattatggacttaccctaaacatatcttatcatcattaccagttgcaaaatattagaatgtgttgtcactgtttcatttgattcctagaaggttagtcttagatatgttactttaacctgtatgctgtagtgctttgaatgcattttttgtttgcatttttgtttgcccaacctgtcaattatagctgcttaggtctggactgtcctggataaagctgttaaaatattcaccagtccagccatcttacaagctaattaagtcaactaaatgcttccttgttttgccagacttgttatgtcaatcctcaatttctgggttcattttgggtgccctaaatcttagggtgtgactttcttagcatcctgtaacatccattcccaagcaagcacaacttcacataatactttccagaagttcattgctgaagcctttccttcacccagcagagcaacttgattttctacaacttccctcatcagagccacaagagtatgggatatggagaccactaaaactacatccctttggccttaccagggaaatattgggaaggaaggaccttgtattactacctaatgaccccatagtattgtttgacagtctatacaaccagatgagcaggcaaggtagtaccctgctaaagagacaggctttctcatatctcataaatatttcacatcctggttctacatgctggttttattccatattagccatgaggtcttcagcaaattacttaatgtcattaaacctcaatttcttcatcctgaaaatgaggatgataataataagagtatatatctaataggcttattgtgaggattaaattaggtaatataggcaaagacctagcatacagtttgcttacaaacatcaacaaaagaaagagacaggaagagatgaagtgtgcaagagagagtgagagcaaccatcaatgtcagacagccaaaaaatgggcatatagatttttttataaatagacctcatatgtctcatttgcatgggcttttgggatgattaaagcctattgttctctaggattacttgaaatacacatttcctgcaggttacagcccaatggacacagaatgacttgtgtattagtccatccattctcacattgctatacagaattacctgagactgggtaatttgtaaagaaaagaggtttcattggctcatggttccacaggctatacaggacgcatcgatggggaggcctcaggaaacttacaatcatggcagaaggcgaaggggaagcaggcacatcctacatggctggagcaggaggaagagaaagcaaagggggaggtgccccacatacttttaaacaaccagatctcgtgaagactcactcactatcgtgagaacaccgcaggggaaatccacacccatgatccaatcacctcccatcagacccctcctccatcactggggattacaattcaacatgagatttggtggggacacggatccaaaccgtatcaacttgtatcattctgagtaattgcaactttcgaatgggtggtagggttggcaattgccaaaagccatggtttggagtcacttgcatcaggcctgggtttccccctggagcaggctgagcttggctgccttctaaggcctcttctgctctggacatttacaggcttctgagccaggagagaacactaagcaatgaaacacaggaggaaaaattaaaaacaccacctttaaattttggaaagtattttggagatacctgtgccctgctctctaaggagttcctgtagggatttctgcttatgaattccagtatattgtttctctttgggatgataaatggagtttctgttgccacaccttgccacagacccactttttgaaaaacactaaaatccactttgcaagtgtataaatattgcaggcaggcagcttccacattctttggcaagggaacaaaatactatttaataatgcaggttccagcttttctcctgacaatgcaaagtgccaatgattattgaaaagggaatttgaaatctgccagaatccactcagttttccttgtgtggttacatttccatcctgtcaccctcgctagtgaagacaattgtttcagccattgagaaaaaaaaaaaaaaggtattttataagattgcaagaaagtgatttaaaccatgactatgtctgttaactgtttgctttgtttctctgactgtgtgcctctctagtcacccaatcttctttagctatcctgtgggctttttcctgttgtcaaaaagcatggtctacccaaagccattcttcaagcatctgatttcccagctgtctttctgctatatatttaaacttctagttctctttggggaagagggtggtagacttgtgtgaggatatagtctgaatgaagtctccgagtgattttttgttgatgttataggggtgggagttcggggagaggagggagagtctttggcctcacactcccctctgagtcctgaatggggttctctcagcatctcattttcccgctattcctgacacactcctccctgaccctattttagaggtccctgttatcaaatggaagtgcttcttatgtcttccttcattctgctaagctgactgttctctatagaaatctgtacccccagcttttctaccaatgcgaatcttcgtttttggaaaatttcttttaccttctctaggaaatcattctctacatcactctatttctttagcaatcagggactacatttggatgtataagtatatacatattaagtttctagatattctttttctttttttaaaattattttttattttattattattatactttaagttttagggtacatgtgcacaatgtgcaggttagttacatatgtatacatgtgccatgctggtgtgctgcacccattaacacgtcatttagcattaggtatatctcctaatgccatccctcccccctccccccacgccacaatagtccccagagtgtgatgttccccttcctgtgtccatgtgttctcattgttcagttcccacctatgagtgagaacatgcggtgtttggttttttgtccttgtgatagtttactgagaatgatgatttccaatttcatccatgttcctacaaaggacatgaacttatcattttttatggctgcatagtattccatggtgtgtatgtgccacattttcttaacccagtctatcattgttggacatttgggttgcttccaagtctttgctattgtgaatagtgccacaataaatatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtgtctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtaggttacctgttcactctgatggtagttttttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccactttcagctttctgcatatggctagccagttttcccagcaccatttattaaatagggaatcctttccccattgcttgtttttctcaggtttgtcaaagatcagatagttgtagatatgttgtgttatttctgagggctctgttctgttccgttgatctatatctctgttttggtaccagtaccatgctgttttggttactgtaggcttgtagtatagtttgaagtcaggtagtgtgattcctccagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctactcatgagcatggaatgttgttccatttctttgtgtcctcttttatttcattgagcagttgtttgtagttctccttgaagaggtccttcgcatcccttgtaagttggattcctaggtattttattctctttgaagcaattgtgactgggagttcactcatgatttggctctctgtttgtctgtcattggtgtataagaatgcttgtgatttttgtacattgattttgtatcctgagactttgctgaagttgcttatcagcttaaggagattttgggctgagacagtggggttttctagatatacaatcatgtcatctgcaaaaagggacaatttgaattcctcttttcctaattgaataccctttatttccttctcctgcctaattgccctggccagaacttccaacactatgtcaaataggagtggtgagagagggcatccctgtcttgtgccagttttcaaagggaatgcttccagtttttgcccattcagtatgatattggctgtgggtttgtcatagatagctcttattattttgagatatgccccatgaatacctaatttattgagagtttttagcatgaagcgttgttgaattttgtcaaaggccttttctgcatctattgagataatcatgtggtttttgtctttggttctgtttatatgctggattccacttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagctcctgttattggtctattcagagattcaacttcttcctggtttagtcttgggagggtgtatgtgtcgaggaatttgtccatttcttctaggtattctagttgatttgcgtagaggtgtttgtagtattctctgatggtagtttgtatttctgtgggatcagtggtgatatcccctttatcattttttattgcatctatttgattcttctctcttttcttctttattagtcttgctagtggtctatcaattttgttgatcctttcaaaaaaccagctcctggattctttaattttttgaagggttttttgtgtcactatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatgtccctctacacactgctttgaatgtgtcccagagattctggtatgttgtgtctttgttctcgttgctttcatagaacatctttatttctgccttcgtttccttatgtacccagtagtcattcaggagcaggttgttcagtttccatgtagttgagtggttttgagtgagtttcttaatcctgagttctagtttgattgcactgtggtctgagagacagttttttataatttctgttcttttacgtttgctgaggagagctttacttccaactatgtggtcaattttggaataggtgtggggtggtgctgaaaaaaatgtatattctgttgatttgggttggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatgcatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtcactgcacatgagatgggttcctgaatacagcacactgatgggtcttgagtctttatccagtttgccagtctgtgtcttttaattggagcatttagtccatttacatttaaagttaatgttgttatgtgtgaagttgatcctgtcattatgatgttagctggttattttgcttgttagttgatgcagtttcttcctagcctcgatggtctttacaatttggcatgattttgtagtggctggtaccggttgttcctttctatgtttagtgcttccttcaggagctcttttagggcaggcctgctggtgacaaaatctctcagcatttgcttgtctgtaaagtattttatttctccttcacttatgaagcttagtttggctggatatgaaattctgggttggaaattcttgtctttaagaatgttgaatatcggcccccactctcttctggcttgtagagtttctgcccagagatccgctgttagtctgatgggcttccctttgtgggtaacccaacctgcctctctggctgcccttaacattttttccttcatttcaacttcggtgaatctgacaattatgtgccttggagttgctcttctcgaggagtatctttgtggcgttctctgtatttcctgagtctgaatgttggcctgcctttttagattggggaagttctcctggataatatcctgcagagtgttttccaacttggttccattctccccgtcactttcagatacaccaatcagacgtagatttggtcttttcacatagtcccatatttcttggagtctttgttcatttctttttattcttttttctctaaacttcccttctcgcttcatttcattcacttcatcttccatcactgataccctttcttccagttgatcgcatcggctcccgaggcttctggattcttcacgtagttctcaagccttggctttcagctccatcagctcctttaagcacttctctgtattggttattctagttatacattcttctaaatttttttcaaagtttttaacttgtttgcctttggtttgaatttcctcctgtagctcagagtaatttgatcgtctgaagccttcttctctcaactcgtcaaagtcattctccgtccatctttgttctgttgctggtgaggaactgcattcctttggaggaggagaggcgctctgctttttagagtttccagtctttctgctctgttttttccccatctttgtggttttatgtacttttggtctttgatgatggtgatgtacagatgggtttttggtgtggatgtcctttctgtttgttagttttccttctaacagacaggacccttagctgcaggtctgttggagtttgctagaggtccactccagaccctgtttgcctgggtatcagcagcagtcgctgcagaacagcagattttcgtgaaccacaaatgctgctgtctgatctttcctctggaagttttgtctcagaggagtacccggcagtgtgaggtgtcagtctgcccctactggggggtgcctcccagctaggctgctcaggggtcaggggtcaggggtcagggacccatttgaggaggaagtctgcccattctcagatctccagctgcatgctgggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctccacccagttcgagcttcctggctgctttgtttacctaagcaagcctgggcaatggcgggtgcccctcccccagtctcgctcccaccttgcagtttgatctcagactgctgtgctagcaatcagcgagattccgtgggcgtaggaccctccaatccaggtgcgagatataatctcctggtgtgccgttttttaagcccgttggaaaagcacagtattagggtgggagtgacctgattttccaggtgccgtctgtcacccctttctctgactagcaaagggaactccctgaccccttgtgcttcccaagtgaggcaatgcctcaccctgctttggctcgcgcacggtgcactgcatccactgtcctgtgcccactgtctggcattccctagtgagatgaacccggtacctcagatggaaatgcagaaatcacccgtcttctgcgtcactcacgctgggagctgtagaccggagctgttcatattcggccaccttggctcgaccc

SEQ ID NO: 12799 - DNA, 1086 bp, Homo sapiens
ttatcctttaaggtttttttttttttttttgcatttatttatttatttattttcattatactttaagttttagggtacatgtgcacattgtgcaggttagttacatatgtatacatgtgccatgctggtgcgctgcacccactaactcgtcatctagcattaggtatatctcccaatgctatccctcccccctctccccacccctccacagtcccccgagtgtgatattccccttcctgtgtccatgtgatctcattgttcaattcccacctatgagtgagaatatgcggtgtttggtttttcgttcttgcgatagtttactgagaatgatgatttccaattccatccatgtccctacaaaggacatgaactcatcattttttatggctgcatagtattccatggtgtatatgtgccacattttcttaatccactctgtcattgttggacatttgggttggttcgaagtctttgctattgtgaataatgccgcagtaaacatacttgtgcatgtgtctttatagcagcatgatttatagtccttttggtatatacccagtaatgggatggctaggtcaaatggtatttctagttctagatccctgaggaattgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattg

SEQ ID NO: 12800 - DNA, 4933 bp, Homo sapiens
tttttttattggctttttttaaattattatactttaagttctagggtacatgtgcacaatgtgcaggtttgttacatatgtatacatgtgccatgttggtgtgctgcacaccattaactcatcatttacattcggtatatctcctaatgctatccctcccctatccaccaaccccatgacaggcccctgtgtgtgatgttccccttcctgtgtccatgtgttctcattgttcaattcccacctatgagtgagaacatgcggtgtttggttttttgtcctcgcgatagtttgctgagaatgatggtttccagcttcatccatgtccctacaaaggacatgaactcatccttttttatggctgcatagtactccatggtgtatatgtgccacattttcttaatccagtctatcattgctggacatttgggttggttccaagtctttgttattgtgagtagtgtcacaataaacatacatctgcatgtgtctttatagcaacaagatttataatcctttgggtatatacccagtaatgggatggctgggtcaagtggtatttccagttctagatccttggggaatcaccacactgtcttccacaacggttgaactagtttacagtcccaccaacagtgtaaaagtgttcctgtttctccacagcctctccagcacctgttgtttcctgactttttaatgatcaccattctaactgttgtgagatggtatctcgttgtggttttgatttgcatttctctgatggccagtgatgatgagcattttttcatgtgtctgttggttgcataaatgtcttcttttgagatgtgtctgttcatatcctttgcccactttttgatggggttgtttggttttttcttgtaaatttgtttgagttcattgtagattctggatattagccctttgtcagatgagtagattgcaaaaattttctcccattctgtaggttgcctgttcactctgatggtggtttcttttgctgtgcagaagctctttagtttaattagatcccatatgtcaattttggcttttgttgccattgctttttgtgttttagacatgaagtccttgcccatgcctatgtcctgaatggtattgcctaggtttacttctagggtttttatggttttaggtctaacatttaagtctttaatccatcttgaattaattttgtataaggtgtaaggaagggttccagtttcgtctttctacatatggctagccagttttcccagcaccatttattaaatagggaatcctttccccattgcttgtttttctcaggtttgtcaaagatcagatggttgtagatgtgtggggttatttctgagggctctgttctgttccattggtctagatatctgttttggtaccagtcccatgctgttttgattactgtaagccttgtagtatagtttgaagtcaggtagcatgatgcctccagctttgttctttttgcttaggattgtcttggcaatgcaggctctttcttggttccatatgaactttaaagtaattttttccaattctgtgaagaaagtcattggtagcttgatggggatggcattgaatctataaattaccttgggcagtatggccattttcacgatattgattcttcctatccatgagcatggaatattcttccatttgtttgtgccctcttttatttcattgagcagtggtttgtagttctccttgaagaggtccttcacatcccttataagttggattcctaggtattttattctctttgaagcaattgtgaatgggagttcactcatgatttggctctctgtttgtctcttcttgatgtataagaatgcttgtgatttttgcacattgattttgtaccctgagactttgctgaagttgcttttcagcttaaggagattttgggctgagacaatggggttttctagatatacaatcatgtcgtctgcaaacagggacaatttgacttcctcttttcctaattgaataccctttatttctttctcctgcctgaatgccctggccagaacttccaacactacgttgaataggagtggtgagagagggcatccctgtcttgtgccagctttcaaagggaatacttccagtttttgcccattcagtatgatattggttgtgggtttgtcataaatagctcttattattttgagatacgtctcatcagtaccaatttattgagaggttttagcatgaaggaccgttgaattttgctgaaggccttttaggcatctattgagataatcacgtggtttttgtctttggttctgtttatatgctggattaggtttatcgattttcgtatgttgaaccagccttgcatcccagggatgaagtccatttgatcatggtggataaactttttgatgtgctgctggatttggtttgccagtattttattgaggatttttgcattgatgttcatcagggatattggtctaaaattctcttgttttgttgtgtctctgccaggctttggtatcagggtgatgctggcctcataaaatgagttagggaggattccctctttttctattgattggaatagtttcagaaggaatggtaccagctcctccttgtacctctggtagaattcagctgtgaatccgtctggtcctggactttttttggttggtaagctattaattattgcctcaatttcagagcctgttattggtttattgagtgattcaatttcttcctggtttagtcttgggagggtgtatgtgcccgtgaatgtatccatttcttctagattttctagtttatttgtgtagaggtgtttatagtattctctgatggtagtttgtatttctgtgggatcggtggtgatatcccctttatcattttttattgcctctatttgattcttctctcttttcttctttattagtcttgctagcagtctatcaattttgttgatcttttcaaaaaaccagctcctggattcattgatttttttgaagggttttttgtgtctctatctcctccagttctgctctgatcttagttatttcttgccttctgctagcttttgaatgtgtttgctcttgcttgtctagttcttttaattgtgatgctagggtgtcaattttagatctttcctgctttctcttgtggtcttttagtgctataaatttccctctatacactgctttaaatgtgtcccagagattctggtatgttgtgtctttgttctcattggtttcaaagaacatctttatttctgccttcatttctttgtgtacccagtagtcattcaggagcaggttgttcagtttccatgttgttgagtggttttgagtgagtttcttaatcctgaggtctagtttgattgcactgtggtctgagagacagtttgttataatttctgttcttttacatttgctgaggagtgctttacttccaactatgtggtcaattttggtataagtgcaatgcggtgctgagaagaatgtatattctattgatttggggtggagagttctgtagatgtctattaggtccacttggtgcagagctgagttcaattcctgtatatccttgttaactttctgtctcgttgatctgtctaatgttgacagtggggagttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttgtctcttttgatctttgttggttttgagtctgttttatcagaggctaggattgcaacccctgcctttttttgttttccatttgcttggtggatcttcctccattcctttattttgagcccatgtgtgtctctgcacatgagatgggtttcctgaatacagcacactgatgggtcttgactctttatccaatttgccagtctgtgtcttttaatgggagtatttagctcatttacatttaaggttaatactgttatgtgtgaatttgatcctgtcattatgatgttagctggttattttgctcattagttgatgcaatttcttcctagcatcgatggtctttacaatgtggcatgtttttgcagtggctggtgctggttgttcctttccatgtttagtgcttccttcaggagcctttgtagggcaggcctgatggtgacaaaatctctcagcatttgcttgtctgtaaaggattttatttctccttcacttatgaagcttagtttggctggatatgaaattctgggttgaaaattattttctttaccaatgttgaatattggcccccactctcttctggctcgtagagtttctgccgagagatcagctgttagtctgatgggcttccctttgtggataacccagcctttctctctggctgcccttaacattttttccttcatttcaactttggtgaatctgacaattatttgtcttggaattactcttctcgaggagtacctttgtggtgttctctgtatttcctgaatttgaacgttggcctgccttgctagattggggaagttctcctggataacatcctgaaaagtgttttccaacttggttcctttctccccatcactttcaggtacacccatgagacatagatttggtcttttcacatagtcccatatttcttggaggctttgttcgtttctttttactcttttttctctaaacttctcttcttacttcatttcattcatttgatcttcagtcactgataccctttcttccagttgatggaatttgctactgaagcttgtgcatttgtcacatagttctcgtgccatggttttcagctccatcaggtcatttaaggacttctctacactggttattccagttagccattcatctaatcttttttcaagatt

SEQ ID NO: 12801 - DNA, 23576 bp, Homo sapiens
tttaaattttttttatttttttattttattattattatactttaagttttagggtacatgtgcacagtgtgcaggttagttacatatgtatacatgtgccatgctggtgtgctgcacccattaactcgtcatttagcattaggtatatctcctaaaactatcccttccccctccccccaccccacaacagtccccagagtgtgatgttccccttcctgtgtccatgtgttctcattgttcaattcccacctgtgagtgagaacatgtggtgtctggttttttgtccttgcgatagtttactgagaatgatgatttccaatttcatctgtttatggatgtagatggcatttctctaccttcagtagcttcgtgggaccatcctttcatttcctctcctttcattttatctctcttccctttgtttcccttctgattcctcctttgccctgaaggaaagttatgaagctctaggtggcagagtgcaaatgggtaaagatggggtgttcattagcgcctgatgtattcactgtgtgtaaacccagcctacccatctcagagaccacctttgcctgaaatcctctatttaacatgtggcattcagagcagaagcgtctgaaaggcacatttcttccactaaacctccaagaggacaaacccagcaaggacatagtggatttatctgagtttaatggtattagcctgagaccagccatgatgtgccaaagacattggcaatttggaaaactaccaacagagtcctaatgtcagtcatgtctgtatagggctaccttggtgacttttttgctaaaattcagggacttagctggtctcctcagccaggcagttggagtgatttattttctgggactgaaatgaccagtggattcagtgaaagcaattagactgactttgtatagatactggaattttcctttcccatgattaacaaacagagtaattaagcctcgtttgtttgtgctcattctggaacagaacagctatggcaaagggggaggggaaaggggttgacttttctctggcactggaaatcaaaatgcacatttgtctttgtgtatacagaaagagagggaaaaagagaacaagaggggcagagaaggagagaggcagagaagaagtgaggcagagaacagaaattacctgctttagagagtggagtggggttgggactccctttccaggggttggaagattaaggcagcacttgggtctggaacactgctactgttccccaggtatggttaaatagatacatcttggcaacagattcagaatccccccccaagacctgtaattaaccgttacaattgcctatgttttccaaaatgaaaatttccttaaaacttaatccacatattttaaccttttaaatcttttgtaaagagataaatagcatgtgggggaagttaccccttcttgaagaatgacgattaacctgaactcagctataattataaggaaaggagaatctttagaaaagcaatggcagggtactaggttttatatcctgttgtacctagatttagagtattttggtttccattacagctgcctgagcatttcttcctctgtgtaagatgatttttagatttctcattcaccacatgctttaaattttaataacgttatagacatggaaggtcctgattttctgcctcttaccagtctcatcctcttacctcagctgctagaaactgttctctccacagtaagcctgtttgcatcctaaagccttcagcagtgagggtggaaatgggttcttgaatatcaggctcagagtggggacctgtgacctgctttccagatggaaaccatgagagccgtgcatgtagacatattcccaattgctgaaaacaaagaggtggtaagcacaggatggtgctggtggcgaagaaccatgtcttctcatttaacaaagactattcagaaaatagacattttagaacaaatctgaatgctaatagaatttctgaaaagggagagaatggatataaagtatactgtaatcaacactgggaagttctggtagaccaaaatgaatgtacagtttctgtgtggcagcctgcagccaagccagatggctgacagtgggccttaccttcactacctcttgagtatagacaatgaaaaaaattgagaacatggaaagagttttatcaagacttggaagatctttaaatcatccttgcatgtagtgcacaatcatggctcacacaccagctatcttgcttcccagttatgaaaatggagcactctgtccccacccccaacatgacccacaggaatctgtgtctcctggaaaggctggggactgcagtggccattgagaccaagtggaaaaaaaatctcagtgcacccagcaggccacttctctctagcaatatcaaagtgtgctgtttaggaaagccagcctcttccttagtttgagatcctctatttttatataatattaactctcatttcaatgtgaacatctgaacaaaaagttttttccaaatgaatagagccaaggggagatattgtattgagtgtggacagcagaatgagaaagaaaatgttttagtacttctagttccatttagtcttcttgatacttttctcttaggccaaaccactttgagtaacagaggtccttggctaagttccaggtggaaagaagcaaactggcattcagttccattctctttctcatcttgcccttttttgaggtagcactgactggtatgttaatttcactggttcatttttcatttaataaatatgtacctaagatttacttcatgggaagtgctgtgttagatgctagtgatgcaaagattaaaaagacaggttgcagcctggagtgactcctttgggtggaattaaggaagcatcaaggaatttagcaactcagtgggaaaggattggggtggagttctagagggggaatctgcttgagctgagatagggcagacaatgagcacgaggtgctcccagcaaggggaataggtcagacaaatgtgggtgagtgagagaatatagagggagccatgaagtaaatgatgaaataaatggagaagatgggaacgtgtacttttatcaagagttggagcatcttctcaattgtctttgcatgtagtgcataaaaccaaggctcatccatcagtcactcttggcctatggaaggtggggtctacatgaaatatgaccttggtgttatactaagcagttttgacttctaagtatttggtagggagcactgaaggatttgcagttgggacttacatgtccatattttcattttggaaaatgtattgtgaccctcagttctaaatgaccgagccttacttaaatcaccttatgcctaaaggaaattttgagtaaagttgaaatattctatgtcttctaaatagtaacctaaatttcatttagataattaaatatgtgtaactacctttctttctctctctctctcttttttttttttttggtctaagttggtctacagtgtctgaaagagttgaatggatttctttagaagcagaggaagtgtactttgatactgttggtgtgccatggatatacaagggcgcagggttagcctgggatgaatcattcacatgaattcagaaacattgctattaaatgaaaaaaatgtatttattatagagtagaatgcaattggcatgttttaaaaacaaacatgaggcatgaaggaagtttctactttgggctgaatctcaagcccttttgggtgggtgcctgcagtggggttgtcaagaagactgagaagcactgggctctgttgttgagcaaagccaagcacaagaaggtccttatgcaaagatggtgtgtcaggagaacatgtctgggtgttagttaatgcttgtggaactctcacaactccactagggggatgaggagctgggaaggtgggggttgtggtgggagggagagtcgtaattcttgtttcaaggcctggcttcttttttacaagatgattagctacatttagaaacctattctttacacattcttaattttgctggagttggaatatcttttcctcttctctgtgttggtattttatgagcagatcaactcaatctgttttcaataacattcaagttaatagtactatgacttagatgaaaagaaaattaaaagttatcaacagcttggtatacttaacccttcctaatgctgggcacattggctctcctttcctggatggactgagaaaattctggaaagtagttgcccaacaaaataggttagtactgtactgcacactttgttcagctttactgtgggcattgtcagatcaggttacagcataggatttaaaggtcaattatgccatgactttaggggaaagaaagagtgactagaaggttaaaaaaaacccctaagttttggcttttaaagacttatgaaattgtattccctttgtgacatttgatgaatcacttttcttaatttccattctgataataatctccctaacgttttcctaggaagctctttcatggcaaaaatactgtcctgtagatgcccgagagagttggggccagttatacagggtgggggagagttggggtagctactcctgtctctccgagttgatttgatactgcttccttgaatttactgaaattaagacacctgaagagattaaaattttgtggcataaaaacagtcacagctaggcatggaactggtttcagggagaatgaccaagttaggcatttagaggatgagaaccaaattacagatatacgaaaattagagaagccaaaatgaccccatgcattaatgaatggcctgagggaacatctgtggttgtctgcgtcttagcttacaaactgaatccagggacgttttcatcacaatgcctgcatctgaatagcatggaaggtcaccaggattaagagttttgacctgtcagcgcaatggggtttaggtttggtatctttatttttggtctgtaagctcttttgttcaaggcaaagttgatctctccctgagccaggccttgagtggaggtggactggcttcgtgtttctaattagtcagacactccccctgctcctgactactgatggatgtcatgttagttcaggaccccaagccctctctctctttgagctgcagtgcagggatccactttagtactgaactgtcatttgtatggttagcatggtggccggctgtcttgagattatgttagcagaccccctccctatccctggctcttgaccttttagcatacagcctcttggcattttcccaaatggaataatatatgtgtaagcacattgaacagcattatatgctgtttgctaatcagatgtggttgactgtaattatcttgcattcagttccttgttggtagatattctgtacaggtagttcattcgtattttggatcttgattaattttcacagtgccatatattgaccttgaaagaagtcttggtcagttttgaaaatctttaaccatgcaatggttagtccttcagccccaccatttactttggctgtctggcctcttacctgaagcatcttattacttgatctctacttcgaatgatctcttttccatcctttgggaaggacagtggcccttgtccctcaggggagaccctcctacatgctgtagctgtgaagctaaatgctcactggttcttactggtttaggggatatggggaggcctggcttgtcctggatccctatcttctactcatgcagtacttcctgtggttccatttaattgtacatttgtatgttggtcatttcaaccttgcttagtggccctctgtcctacttagagacagctaacttttttggctttctggaaaattccttgagatttgttgcagcattgcccactcctcagtcatgtaggccctgcctgtactgcttatcctagcttacattttaaatctcagtacctcaattcttatgatagccaattctatcttagtattatgacttcttgatgtccagcagaaaatattgcaatccattaacacacagagtagtgtagacagttaattgaatggaaatattactagatgtactttatagatgatgaacagattatgacattgtatagatataattgggttcttccttggagagattcatcaataataaaaacaacttttatttattgagaacatatgctggattgcataatgctctaaatatttcctctaacactttcaacctgtatggtgagcattggtatccccattttatagaggaaggacatgagatgcttgcctgaggtggaatcagtgttattgtgccagtatatctgacttcaaagtcagttttccattaggctgtgtggctatatattcacaaagaagaatcctagtggtgataattagtgacctactattggcaggagaagacactagcattctcttgaatgtacaccatatttgcttgtcaactgattgatccttttttgttatctgccagacgctgacatggtcttgaattttaaaggtaagtaagactcggctcttacctcaaacatttcatagttgagtgggggaaccacttgtttaatgtcactgattttttggtctgttttagaaaggtcatgaaactactacctttgagctttttcttattccaactcccttttttcccccccgataatggagaaaacttcttgccctaaagaaacgcaccttaagggatggcatggactattgtggatcttcatatgcttgtgggttttttttttctttaaacttattttgttactggagctgtgtgatcttttctttgaggtcaaattccacaaaaggagctaagattgtataattatgtttcacatctatagggcccctcatgatctataaaatgccttccatatacattatttgatttgcttctagaagggcaaatatttgatccctgtttcacagtggtacacttaggggccactcaagggtatgtgatgagctggacatgaccctgagttctccctgcctgtgacatacctccctttcaataagaggaagaggtgttgctggcagaagctttctggaagaatagaaggtgtattagaaggaaatgtggctatgtgcatccctattggtggggaaatagaaactaattgatgtacctcaccaggacaaatggtttggccaactggggcccagaaacaaagcagggggaagccatagaagtcggtgcctgaatcagctagggctgccataacgaaataccacagactgggtggctcatacaacagacatttattttcccatagttctggaggccaagaaggccaagatcaaggtgccagccaatttgggtcttggtgaggacccacctcctggcttacagacttttgccttctagttgtgtcctcccatggggatggggtggttagggcagaccaagttccatggtgccccttcctatatagggcactaatctcatcatgagagtcctactctcctgaactcatctaaccctaatcacctcccaaaggcacatctccaaataccgtcacactggaggttagggcttcaccatgaattttgtggggataccattcagtacatagcataatggtggagaggttaaaacatgtggaggaagatcgcactccaggatggtcagggcaagtgtgtgggtgtttaattgtgggcataaaaggcacaatcaacaaggttatagaaaacaatgtctcagtggtttgtttggactgcaagtaagaggaaagtgggacttgtgaatgcttggcataactcagctcttctctcaactcttggaaactcacagggtaaccagtccccctgaggaccagggaagctgtgacggatgggagagagtgttgtccccattgccataagcagaatgcagacgtgttatttatttatttttgaggctatacgaatatctgttgttttgaaatatattaggtccaaatttgaccccctgggaaagttttctgtcacttgagaggatactgctttatgtatgaccccactagaaagactaatccttggctgggcgcggtggctcatgcctgtgatcccagcactttgggaggctgaggcggccggatcacaaggtccggagttcaagaccagcctgaccaatatggtgaaactccgtctcttctaaaaatacaaaaaaatttagctgggcctgatggtgagtgcctatagttccagctacttgggaggctgaggcaggagaatcacttgaactgggaagcagaggatgcagtgagccaagatcgtgccactgtgctccagcctgggcgacagagcgagactccatctcacaaagaaagaccaatctttgtactttggcccaggtgcatggtgaagtgtatggtcttgtgttcttttgatatactcacctgattgagcagaatctcacacaagtcttcccttgcttccgaagttacaatgactcagtgacagctataaaagccttcttttcatggtaattataatcagacatctgaatacatttatgcatctatagcttctcagttttacacgtaaatagatgccatcagaagtattttgagggctgatttagctcgaagagggtccatttaaaacctattcttgtgttcccatcattttcggcagccaggcaactgaggtcagtgtgctcataaatggcttcgggtgagtgtgtgaattaaaagctcctctctgtgtgatgataacagggtattttctgctcacaattacagaagcatacattttgaaagtaaatagcctcatagttgttctttcaggtactaaagagccagtttatcaagaattaaggcccactgagttagggggcataaaagcagagtggacagggcagcctcaccaagatggagcttgagccaagcgtggtcctcctggccccttgtgggcagccagcaggctactgactctgtggtgcactaaggagctacctttttggactgcattacttaaacatcagagggtaagtattatgcacaaatctgaggaagattaagggatctgggttgctctgtaccgtgagagatgagattagctttccccagctggcgagactggagacattttaaaaagcattttaaccagagggttttctaagttctcctggaatccattaccatctattagctttgaaacactgactgccaaaaagatagggcagtgacagggcgatttgctctcctttctggtgaggtttgaatcccaaggtgccagatgagactggaagggctctccagacctgccgatagaggtagggagatattacacaaagcctgcttacaaatcgggcagctctacagtctcaaatataaaattcggtcattagcttacactgtcacgtttctagctgaatggcaagaggacttaagaccttctgtttggaaagtcagaaactaatgtttttgcttcaactcttaactcacaatgatgtcgtctcctgttgctgcacagtcctgtggagaaaatcagtcagtattcttgttttcctctggatggaggtgattttagagccattagtgcttctagaagcttccctcccctctgggtccctgaggggattcttttggtacaagtagacagagttgtcaacaggtgatcacggacctctgaaaatagtagtaaaagtagcaatcattattctgtgtgtcaggcactgtgccatgggcttttactctccaccgtatttaacacctcaaaatataataggaaagcccaccaacttggcatccattttggatatattttaaaactaaatttacacccatacatttatattttataattttagtatttttgataataaaatttgtttttttgatcacataaagtaaaaactatttgacatttcatctgtctgtaatgaccacaaatagcattttggtgctcattctttcatatatctctctctctttctgtctctctctacacatgcactggtgtgtggcatgggtataaatagattttcacaaattatattatatattttgtacttattgtacatagcttttaaaagttatgttttgttcctttccttccgttgatactcactccctgctcaccaccatcaaccagtgttgaacagcctagtttgtagatgtccacatttctatccatgtttatgtatatatttatgttttgttttctacaaaaagtcaccctccaaagcggtatttgtcatgtgcccaggatccattattcacaattcaaaatggtggacaagatattccaaaaaatgagattattgaaacatatattctctgtatgttacttttctcactcaacaatacctcatggactgcccttcctgatggtttagggctgactcactctgtaatggccttggaataggatatgaggtgggagaccaaccattttttttttttccatttgagtagtcagttgtgcatgtgccatttatcaataagctgttctctccaccatggatcacaagactcaccttgtcacgtagaagcttctgttgatactggaattgatttctgagttcatcagtcagttctgttgtttgttcctatgccatgttttcattttagtggatttaagtctggtatgatgctcccctcataattctttttcaaaagttttctgccaatttttggatatttgatattacctaaaaatgtattatatccacattaaaaattttgggattctaattaaatgtatatatgaattttgaatttatatgctttattttttcttttcctttttaatgacagtataatgctattgtaagttttttcaatttgcattacagatattttaaaaagccctaaacttttccagccacctgattaaattccttcattgattcgagtactttttatttttagagttggtgttcctaggagtatgaatatattattagcaagaagggaaaattttgtcttctcatttactctgtttatagtaactattttttcccctcaatttgaattataatgataacagcaggtatcccatcttattcctggcatttgattgtttggaatgatgtttgcaattgatttttgatgaatccatattcaagaggtttcttttattcctattttacttgaagttttattagaaatggctgttgaatttcaccaaatgcttttttagaacctattgatgtaaccaaccacttttactccgtgcatttgttgctctcatgaatgatggtaatggatttgctgatgtgaaaactgcctttctggagttgtccttgtttgatcattgacaatattcatttgatatagttttgggttttacttcataatgttttatttagaattttaacgaatatttacaaatgagattgctctgtagttttcttttattgtactgcctttaccagttttggttttaaggccaaaccagtttaatgatatggacttaggtgattttccctatgtttctattgttttgaataatttaaataacatttctttcctttaagttatatagaactctctgtgaaatcaactgtttttgccctctgctttttttttcctcttagaaaatcacttctcctatctctcctgtggtaactggtctattcaattttctacttgagtcagttttgttcctttatattttgtggaaagtcacaccaagaacttcagaatgctcttctctcttccccttctgcctgcagccctgcttcttcctaatgcctatgttttcttttgttcctgagtattactatacccttgaagtttgcctcttatttcagaaatctttaatatttatttacatgttctcagtcatggtatcattatccatttagatttcatagtgtatttgcaagatacccttctcaccactcttttctcctttcccctcccctgtccctggagatctctgctctgatttatttttgttgcattagagtctttcttggtgttttcctcagatgaagcatggggttgatttactattgaaactgcattattccaaagattttctttctaactgtataatcttgagaatgttatttaacttatctgggtctcagtctccttaactgtaaaatgggaattctaagaacagagaccttacaggaactttatgaagatgaaatgagttaatatatgcattctggttatctgttgctacattgtccttcagtagctgtgggacactggttccaggacaccctctgccctcccataccaaaatccacaagtgctcaagtcccttatataaaatggcttattatttgcatataacctttgcagctctcctatatactttaaatcatttctatattataatacctaatacaatgtaaatgctatgcaaacagttgttatactgtattttttatgttttaaaaaatatattctatctgtggttggttcacttcatcggtgtcgaacctgtggatatggagggccagcagtatataatgaactaccttaaaacagcagtgtgacaactatgtattattatctctcataggtctatgagttggctgggtttagctgggcagttcttgcttgggggctgtcatggttggagtcagatagcagcagtggctggagtcatctgaaggttcagctgggctgggagtcccagatggcttttttatttattgtttcagtgttcctccatgaggcctctgtctccatcagagtagcctggatttcttacctgctaactcaaggttcccagaggcagaaaactgctggtcttcataatgtcttggcccagaactggtgtagcagtgcttcaaccacattctatgaggtggaagaatacactctaccttgagttggaggagtggcacaagtagagagggagggaaggaattaatgatagccacatttatagacaaactaccacaataagtgaagtgcttagactagaatctggcactgaatgagtgctgtagaattattaactcagtgatattattgcagttgttaaattaccttcagaatttgcttttactctgagagctgaatgatgtcttgtatgagtatagaagtctaggactgtggttcttttctgtaagtaatgtgcagatgaagtgtgatgccagtctaatgacttttcctttgtaggcaagctgttatttttatctagaagctttcaggatttttcagtaaaagcagaaataagatagttatcaccacttattaacagacctttggaggttctagaaaatataagacaagaaaaggaagaagtagatgttgaaaaaaataaaatatcctctctgtgctgatgattatttttagcaagcccaggaaactccattaagaaaaaaaacaactaactagaattaaagagggaacacggtaagatgagacattacaagataaacatgtaaacacaatagcttttctttttttctattctagcaagtaccatagtttggattgatagaagtcttttataatatattcttaacctggtactggacgagctctttcagttcagttggatgagacttcttatgccaactgaagtcttttaaaaaagcagggatttttttctcttttatttcttcagttactgtctctcttccatatactcctttttctctattatttgcttggctgtgatatgacaattgccttttcatgggaagatttgttcttttgttgtaaagttctgtttttcctattgtagaagattatcctttatgatatgatgggaatagcaaagatggctttgtgtgtgtgtgtgtgtgtgtgtgtgtgtgtgtgtatgtgtatgtgcacactcgttttgttgtttttgtctcctggctgtcctgaaagtgttcccagcagattttcagagggatgctgctttccttactttcctgttactgaggaggctagagtggggaagggatgggggtagcagagaagctttcctggagacctccacaaaggacaggcagctagacctgctccagccctagccctctcatggggttgttgctgttcacagttcccaaacagctcgacctgaattgaactctgagggtgaatagaacaatgagaagcctggaaaccaacataaggggactcagccaccagaaaataataagcagaaggtaagtggtgcaagtcaaacagaatggatagaggagaaggtttaatcctaacaaaaaggtataaaataattccattgcaaaaaatgaagttttctagaatttaaacgagtagtttaaaaatgagacattcaatatatggaaaagatacccaagaaattgctaagagattacctccagagaggaggcaaagggatggctggggaccaaggtgagaagatgacttcctttattcattgacatttgccactatgccaaaatgatatatcatgtatatatgcagttatgtagttgaatggagaatgaagaggaaggtgttaaaaaaaaaatcaagcagtggtgttaggccagggtggaaatttcctgtttatgaattatagtagaatacaacatttaatttggaattaaaaaaaatacatcttttttttattttcttctaatgaaactgcaacagtgttattagtacctgtaactttgtcagcaatagaaatcaaaaatattttcatataatattacagttgttgcagacatcttgaatgtcatttatgttcatcagagcttaaagttataattgttcatagtaccaccactagagcttggtatttaatgtcataataaaagcacatgttattgagtttgtgtattttagtattttgatacttaaataggattggtttccttagtaatcctatggatttcactttatacatttaaacatattatatttggggtagggtctctagctttcattagactgccaaagggatcatgccctcaaaaaggtcaagaaacctatgggatatagggaccattggagtaaactattggcccagaagatcaagtggaagagcaaaaacatataaaaatataaaaataaaagtggaaaaaaaccaaataaaatataaataataaattataaaataaaatatataaattataagtatatggataaataaaaataagtacataatgaaataaataaaatcattagagggacataaagagacttggaggacagtctaacacacccaaaatgggaagaacagaatccttcataataaaaggataaatcttcccaacaaaggatggtggttgggaacattatgtctaataaggcttttgtcctttgttgttgctttatttggatgctcattttaagaaaaacacagcattggcaaagctttgttggaccacacttttgctggtccacaaaaccctccagctgacaacccacagatgcagggtggaaaagcctgtgtgactgtcggaggggagcagctgggtccttcccagcacactgcagctggagagagtgtcctggcagtgggaagtctcagcacaatggcctggtgcttttccacctgtgagaacagctagtgagtgatgcgtgcgctgcgttggcagcagctgcagtagtgtgtccactgtctgagcacttcttgccacttattctaccctcctgggttacccagctcttaccattcttatagggggtaatgaagacatggatttgagaacccttgaattgtttcctgctgatcgataggtcgcacatggctgtttacctagcaaacggaaagcaacatcagttcttgagactggtgactgtatgtgagaaaacgataaaaggatgggggcagggtgtgtgtgtgagtgaatgccgcattggtgtgtttacagttcagtgtctttccggagcatgagagacgaacaagtattgtttaaacgaatgctgtttaaaccctgggattatatagtcatgtgaacttttttggaggaaactgcaaatgttgctagccattgtaattgtgttagttcttgactaaatgtcgtatataaacttcctggtaacaattttaataacgtttgctacttaattataacagcattttacaaaagtgtcagggcatccttaatttatgttttgataagagtgaaagattcagaaagtttgctttcagttatctaaaacttggggccttctccagcatatgcaaacaaatagtaatgcttaaatgcactgtgtgtatgagatgggtttttgtttgtgtaaatctagatggatcctcactccgggggcttaactaaattgggatttacttttctcggtaatatgaagactggtagtgggtagctgaaagcaggtatgaaagctttgggggataccattctcatttcatctttccatacctcgtgctcccccaaatgacaaccatgcctttgggcttcttatctgtatttcaggcagctagaaggctgaaggacaaagaaggaaaagcaaaagtccagtgcaaagctttcttggaaggcctgctagtggcttccacttacatctcattgatcaggaatgcaccatatgtccatcagtatggatccatctagtggcttccacttacgtctcattgatcaggaatgtaccacatgaccatcagtatggttccatccagtggtttccacttacatctcattggtcaggaatgcaccacatgaccacctgtatggaattctgggaagtgtattttgggtcaggccggttgccaccctgaacaaaatttttctattcataatgaagaaggagtgattggatttgggatatgtaagcagaagtgccaggcacaggagccttcaccattcccctctatctttgttccagctgatttctgctcatctggaaggctctgtctgtgccatctcttccaggaagccctctgtgagccccaggtggggttaagtgtccattcttcgagcattgatggtactctgtatccacacatctcatattccctgtctttttccacatacacattttctatatctggtggaaatctctactttaggaatattacctcattatgcttgtaagtgccttgagagtaggatttgtgtccaatgtttattcccagatcttttatttttagtattattttaatttaaaatttttaaatctcaataggtttttggggaacaggtggtgtttggttacatgaataagttcttcagtggtgatttctgagattttggtgcacccaacacccgagtagtgtacactgtacccactgcatagtcttttatcccttgccaccccccaccccttcccccgaatccccaaagttcaatgtatcattcttacgcctttgcatcctcataacttagctccaacatatgagtgagaacatgtgatgtttggttttccacttctgagttacttcacttagaataatagtctctggatacctaattcatgagaggcttaaaacctagatgacgggttgacaggtgcagcaaaccaccatggcacatgtatacctatgtaacaaacctgcacgttctgcacgtgtatcccagaacttaaaaaaaaaaaagaataatagtctccaattccatccaggttgctgcaaatgccattatttcattcctttttatggctgaatagtattccatggtgtgtgtttgcgtgtgtgtgtgtgtgtgtgtgtgtgtattacatttcctttatccacatgttaactgatgggcatttgggctggttccatatttttacaattacaaattgtgctcctgtaaacatgcatgtgcaaatatctttttcatataatgacttattttcctctgggtagatacctagcagtgggattgctggatcaaatggtagatctatttttagttcacttaggaatctccacactgttttccatagtggctgcactagtttacattcccactaacagtgtagacgttttcccttttctccttggcatccatgccaacatctgttatttttgattatggccattcttgcaggagtgagttggtattatattgtggttttgatttgcatttccctgatgactagtgatgctgagcatttttccatatacttgttggctgtttgtgtatcttcttttgagaattgtctattcatgtccttagcccactttttttttatttttttattttattataattatactttaagttttagggtacatgtgcacaacgtgcaggtttgttacatatgtatacatgtgccatgctggtgtgctgcacccattaactcgtcatttagcattaggtatatctcctaatgctatccctcccccctcccccaaccgcacaacagtccccaaagtgtgatgttccccttcctgtgtccatgtgttctcattgttcaattcccacctatgagtgagaacatgcagtgtttggttttttgtccttatgatagtttactgagaatgatgatttccaatttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcagtaaacatatgtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaaaattttctcccattttgtaggttgcctgttcactctgatggtagtttctcttgctgtgcagaagctctttagtttaattagatcccatttgtcaattttggcttttgttgccattgcttttggtgttttagacatgaagtccttgcccctgcctatgtcctgaatggtaatgcctaggttttcttctagggtttttatggttttaggtctaacgtttaagtctctaatccatcttgaattaatttttgtataaagtgtaaggaagggatccagtttcagctttctacacatggctaaccagttttcccagcaccatttattaaatagggaatcctttccctattgcttatttttcccaggtttgtcaaagatcacatagttgtagatatgcgccattatttctgaaggctctgttctgttccattgatctatatctctgttttggtaccagtaccatgctgttttggttactgtaggcttgtagtatggtttgaagtcaggtggcgtgatgcctccagctttgttcttttggcttaggattgacttggcgatgcgggctcttttttggttccatatgaactttaaagtagttttttccaattctgtgaagaaaatcattgttagcttgatggggatggcattgaatctataaattaccttgggcagtatggccattttcacgatattgattcttcctacccatgagcatggaatgttcttccatttgtttgtatcctcttttacttcattgagcggtggtttgtagttttacttgaagaggtccttcacatcccttgtaagttggattcctaggtattgtattctctttgaagcagttgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctagatatacaatcatgtcgtctgcaaacagggacaatttgacttcctcttttcgtatttgaataccctttatttccttctcctgcctaatttccctggccagaacttcccacactatgttgaataggagtggtgagagagggcatccctgtcttgtgccagttttcaaagggaatgcttccagtttttgcccattcagtatgatattggctgtgggtttgtcatagataggtcttattattttgagatacatcccatcaatacctaattgattgagagtttttagcatgaagcgttgttgaattttgtcaaaggccttttctgcatctattgagataatcatgtggtttttgtctttggttctgtttatatgctggattacatttattaatttgcgtatattgaaccagccttgcatcccagagatgaagcccacttgatcatggtggataagctttttgatgtgctgttggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggaatagtttcagaagcaatggtaccagttcctccttgtacctctggtagaatttggctgtgaatccatctggtcctggaccctttttggttggtaagctattgattattgccacaatttcagagcctgttattggtctattcagggattcaacttcttcctggtttagtcttgggagggtgtatgtgtcaaggaatttatccatttcttctagattttctagtttatttgcatagaggtgtttgtagtatcctgtgatggtagtttgtatttctgtgggattggtggtgatatccgctttatcattttttattggtctatttgattcttctctgttttcttctttattagtcttgctagtggtctatcaattttgttgatcctttcacaaaaccagctcctggattcattaattgtttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcctcctttgtctcttttgatctttgttggtttaaagtctgttttatcagagactaggattgcaacccctgccttatttgttttccatttgcttgatagatcttcctccatccttttattttgagcctatgtgtgtctctgcacgtgagatgggtttcctgaatacagcacactgatttgtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagtggctggtatcagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtggttaacccgaccgttctctctggctgcccttaacagtttttccttcatttcagctttggtgaatctgacaattatgtgtcttggagttgctcttctggaggagtatctttgtggcgttctctgtatttcctgaatctgaattttggcctgccttgccagattggggaagttctcctggataatatcctgcagagtgttttccaacttggttccatcctccccatcactttcaggtataccaatcagacgtagatttggtcttttcacatagtcgcatatttcttggaggctttgttcgtttctttttattcttttttctctaaacttcccttctcgcttcatttcattcatttgatcttccatcactgataccctttcttccagttgatcgcgtcggctcctgaagcttctgcattctttgcgtagttctggagccttggctttcggctccatcagctcctttaagcacttctctgtattggttattctagttatacattcgtctaaatttttttcaaacttttcaacttctttgcctttggtttgaatttcctcctgtagctcggagtagtttgatcatctgaagccttcttctctcaacttgtgaaagtcatcctccttccagctttgttgcattgctggtgaggaactgcattcctttggaggaggagaggcactctggtttttagagtttccagtttttctgctctgttttttccccatctttgtggttttatctacttttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagcggtgtttgcaaaaccgcggattttcgtgatctgcgaatgctgctgtctgatcgttcctctagaagttttgtctcagaggagtacccggccgtgtgagttgtcagtctgcccctacttgggggtgcctcccagttaggctgctcgggggtcaggggtcagggacccacttgaggaggcagtctgcccgttctcagatctccagctgcgtgctgggagaaccactgttctcctcaaagctgtcagacagggacattt

SEQ ID NO: 12802 - DNA, 5647 bp, Homo sapiens
ttttttttaatactttttaaaattatactttaagttttagggtacatgtgcacattgtgcaggttagttacatacgtatacatgtgccatgctggtgcgctgcacccactaacgtgtcatctagcattaggtatatctcccagtgctatccctcccccctcccccgaccccaccacagtccccagagtgtgatattccccttcctgtgtccatgtgatctcatggttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcacgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattcatttttgtataaggtgtaaggaagggatccagtttcacctttctacatatggctagccagttttcccagcaccatttattaaatagggaatcctttccccattgcttgtttttctcaggtttgtcaaagatcagatagttgtagatatgcagcattatttctgagggctctgttctgttccattgagctatatctctgttttggtaccagtaccatgctgttttggttactgtagccttgtagtatagtttgaagtcaggtagcgtgatgcctccagctttgttcttttggctgaagattgacttggcaatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccattcgtttgtatcctcttttacttccttgagcagtggtttgttgttctccttgaaaaggtccttcacgtcccttgtaagttggattcctaggtattttattctctttgaagcaattgtgaatgggagttcactcatgatttgtctctctgtttgtctgttattggtgtataagaatgcttgtgatttttgcacattgattttgtatcctgagactttgctgaagttgcctatcagcttaaggagattttgggctgagacagtggggttttctagatatacaatcatgtcatctgcaaacagggacactttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagctacgtcccatcaatacctaatttattgagagtttttagcatgaagtgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagcattttattgaggatttttgcattgatgttcatcagggatatgggtctaaagttctctttttttgttgtgtctctgccaggctttgctatcaggatgatgctgggctcataaaatgagttagggaggattccctctttttctattgattggaataatttcagaaggaatggtaccagctcctccttgtacctctggtagaattcggctgtgaatccatctggtcctggactttttttggttggtaagctattaattattgcctcaattcagagcctgttattggtctattcagaaattcaacttcttcctggtttagtcttgggagggtgtatgtgtcaaggaatttatccatttcttctagattttctagtttatttgcatagaggtgtttatagtattctctgatggtagtttgtatttctgtgggatcggtggtgatatcccctttatcattttttattgcatctatttgattcttctctcttttctttttattagtcttgctagcgttctatcaattttgttgatcttttcaaaaaaccagctcctggattcattgattttttgaagggtttttttgtgtctctatttccttcagttctgctccgatcttagttatttcttgccttctgctagcttttgaacgtgtttgctcttgcttctctagttcttttaattgtgatgttagggtgtcaattttagatctttccttctttctcttgtgggcatttagtgctataaatttccctgtacacgctgctttgaatgtgtcccagagattctggtatgttgtgtctttgttcttgttggcttcaaagaacatctttatttctgccttcatttcgttatgtacccagcagtcattcaggagcaggttgttcagtttccaagtagttgagcggttttgagtgagtttcttaatgctgagttctagttggattgcactgtggtctgagagacagtttgttataatttctgttgttttacatttgctgaggagtgctttacttccaactatgtggtcaattttggaataggtgtggtgtggtgctgaaaagaatgtatattctgtggatttggggtggagagttctgtagagtctgttaggtctgcttggtgcagagctgagttcaattcctggatatccttgttaacttcctgtctcgttgatctgactaatgttgacagtggggtgttaaagtctcccattattattgtgtgggagtctcagtctctttgcaggtctctaaggacttgctttatgaatctgggtgctcctgtattggatgcatatatacttaggatagttagctcttcttgttgaattggtccctttaccattatgtaatggccttctttgtctcttctgatctttgttggtttaaagtctgttttatcagagactaggattgcaacccctgcctttttttgttttccattttcttggtagatcttcctccatccctttattttgagcctatgtgtgtctctgcacgtgagatgggtttcctcaatgcagcacactgatgggtcttgactctttatccaatttgccagtctgtgtcttttaattggagcatttagcccatttacatttaaggttagtattgttatgtgtgaatttgatcgtgtcattatgatgttagctggttattttgctcattagttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcatttacttgtctgtaaaggattttatttctccttcacttatgaagcttagtttggctggatatgaaattctgggttgaaaattcttttctttaagaatgttgaatattggcccccactctcttctggcttgtagagtttctgccgagaaatcagctgttagtctgatgggcttccctttgtgggtaacccaacctttctctctggctgcccttaacattttttccttcatttcaacgttggtgaatctgaaaattatgttcttggagttgctgttctcgaggagtatctttgtggcattctctgtatttcctgaatttgaatgttggcctgccttgctagattggggaagttctcctggataatatcctgaagagtgttttccaacttggttccattctccccatcactttcaggtacaccaatcagacgtagatttggtcttttcacatagtcccatatttcttggaggctttgttcatttctttttattcttttttctctaaacttctcttctcacttcatttcattcatttcatcttccatcactgataccctttcttctagttgatcaaatcggctactgaggcttgtgcattcgtcatgtagttctcgtgccttggttttcagctccatcaggtcctttaaggacttctatgcattggttattctagttagccatttgtctaattttttttcaaggtttttaacttctttaccatgggttcgaacttccttctttagcttggagtagtttgatcatctgaagcgttcttctctcaactcgtcaaagtcattctccatccagctttgttctgttgctggtgaggagctgtgttcctttggaggaggagaggcgctctgatttttagagtttccagtttttctgctctgttttttccccatctttgtggttttatctacctttggtctttgatgatggtgacatacagattgggttttggtgtggatgtcttttctgtttgttagttttccttctaacagtcaggaccctcagctgcaggtctgttgaagtttgctggaggtccactccagaccctgtttgcctgggtatcagcagcagaggctgcagaacagcggatattggtgaaccgcaaatgttgctgcctgatcgttcctctggaagttttgtctcagaggaatacctggccgtgtgaggtgtcagtctgcccctactcgggggtgcctcccagttaggccacttgggggtcagggacccacttgaagaggcagtctgtcctgtccattctcagatctccagctgcgtgctgggagaaccactactctcttcaaagctgtcagacagggacatttaagtctgcagagatttctgctgccttttgttcggctatgccctgaccccagaggtggagtctacagaggcaggcaggcctctttgag

SEQ ID NO: 12803 - DNA, 4842 bp, Homo sapiens
tttgtttaattttttttttaattatacttttaagttctagggtacatgtgtacaacgtgcaagtttgttacatatgtatacaagtgccatgttggtgtgctgctgctgtacccattaactcgtcatttatattaggtatatctcctaatgctatccctcccccctccccccaccccacaacaggccctggtgtgtgatgttccccaccctgtgtccaagtattctcattgttcaattcccacctatgagtgagaatgtgcagtgtttggttttctgtccttgtgatagtttgctcagaatgatggtttccagcttcatccatgtccctgcaaaggacatgaactcatccttttttatggctgcatagtattccatggtgtatatgtgccacattttcttaatccagtctatcattgttggacatttgggttggttccaagtctttgctattgtgaatagtgccacagtaaacatacgtgtgcatgtgtctttatagcagcatgatttataatcctttgggtatatacccagtaatgggattgctgggtcaaatggtatttctagttctagatctctgaggaatcgccacactgtcttccaccatggttgaactagtttacagtccaaccagcaatgtaacagtgttcctatttctccacatcctctccagcacctgttgtttcctgactttttaatgattgccattttaactggtgtgagatggtatctcattgtggttttgaattgcatttctctgatgaccagtgatgatgagcattttctcatgtgtctgttggctgcataaatgtcttcttttgagaagtgtctgttcatatcctttccctactttttgatggggttgtttgattttttcttgtaaatttcagttcttcgtagattctggatattagccctttgtcagatgggtagattgcaaaaattttctcccattctgtaggttgcctgttcactctgatggtagtttcttttgctgtgcagaagctctttagtttaattagatctcatttgtcaatttcagcttttgttgccattgcttttggtgttttagtcatgatgtccttgcctatgcctatgtgctgaatggtattgcctaggttttcttctagggtttttatggttttaggtctaacatttaagtctttaatccatcttgaattaatttttgtataaggtgtaaggaagggatccagtttcagctttctacatatggctagccagttttcctagcaccatttattaaatagggaatcctttccccatttcttgttttggtcaggtttgtcaaagatcagatggttgtagatgtgtggtattatttctgagggttctgttctgttccattggtctatatctctgttttggtaccattaccatgctgtttttgttactgtagccttgtagtatagtttgaagtcaggtagcatgatgcctccagctttgttctttttgcttaggattgtcttggcaatgtgggctcttttttggttccttatgaactttaaagtagttttttccaattctgtaaagaaagtcattggtggcttgatggggatagcattgaatctataaattatcttgggcagtatggccattttcacgatattggttcttcctacccatgaacatgggatgttcttccatttgtttgtgtcttcctttatttccttcagcagtggtttgtagttcttgaagagttccttcacatcccttttaagttggattcctaggtattttattctctttgaagcaattgtgaatgagagttcactcatgatttggctctctgtttgtctgttattggtgtataggaatgcttgtgatttttgcacattgattttatatcctgagactttgctgaagttgcttatcagcttagggagattttgggctgagatgatggggttttctaaatatacagtcatgttatctgcaaacagggacaatttgacttcctcttttcctaattgaataccctttatttctttctcctgcctgattgccctgggcagaacttccagcactatgttgaataggagtggtgagagagggcatccttgtcttgtgccagttttcaaagggaatgcttccagtttttgtccattcagtatgatattggctgtgggtttgtcataaatagctcttattattttgagctacatcccatcaatacctagttaattgagagtttttagcatgaagggttgttgaattttgtcaaaggccttttctgcatctgttgagttaatcatgtgatttttgtctttggttctgtttatatgatggattacatttattgatttccatgtgttgaaccagccgtgcatcccagggatgaagccaacttgatcgtggtgggtaagctttttgatgtgctgctggattcggtttgccagtattttattgaggatttttgcatcaatgttcatcagggatattggtctaaaattctcttgttttgttgtgtctctgccaggctttggtatcagaatgatgctggcctcataaaatgagttagggaggattccctctttttctgttgattgggacagtttcagaaggaatggtaccagctcctctttgtacctctggtaaaattcatctgtgaatctgtctggtcctggactttttttggttggtaggctattaattattgcctcaatttcagagcctgttattggtctattcagagattcaacttcttcctggtttagtcttgggagggtgtatgtgtccaggaatttatccatttcttctggattttctagtttatttgcgtagaggtgtttatagtattctctgatggtagtttgtatttctgtgggattggtggtgatatcccctttatcaatttttttgcatctatttttttcttctctcttttcttctttattagtcttgctagtggtctatcaattttgttgatcttttcaaaaaaccagctcctgaatttattgattttttttttttgaagggttttttgtgtctctgtctccttcagttctgctctgattttagttatttcttgccttctgctagcttttgaatggtttgctcttgcttctctagttcttttaattgtgatgttagggtatcaattttagatctttcttactttttcttgtgggcatttagtgctataaatttccctgtacacactgctttaaatgtgtcccagagattctggtatgttgtgtctttgttctcattggtttcaaagaacatctttatttctgccttcatttcgttatgtacccagtagtcattcaggagcagattgttcagtttccatgtagttgagcagttttgagtgagtttcttaatcctgagttctaattcgattgcactgtggtctgagagccagtttgttataatttctgttcttttacatttgctgaggagtgctttacctccagctatgtggtcaattttggaataattttgtggtgccgaaaagaatgtatattttgttgatttagggtggagagttcagtagatgtctattaagttggctcagtgcagagctgagttcaagtcctggatatctttgttaactttctgtcttattgatctgtcgaatgttgacagtggggtgttaaagtctcccattattgtgtgggagtctgagtctcattgtacattgtaggtctctaaggacttgcttcatgaatctgggtgctcctgtattgggtgcatatatgtatttaggatggttagctcttcttgttgaattgatccctttaccattatgtaatggccttctttgtctcttttgatctttgttggtttaaagtctgttttatcagagactacgattgtaacccctgcttttttttgttttccatttgtttggtagatcttcctccatccctttattttgagcctgtgtgtgtctctgcacatgagatgggtctcctaaatacagcacactgatgggtcttgactatccaatttgccagtctgtgtcttttaattggagcttttagcccatttacatttaaggttaatattgttatatgtgaatgtgatcctgtcattatgatgttagctggttattttgctcgttagttcatgcagtttcttcctagccttgatggtctttacaatttggcatgtttttgcagtggctggtaccaatcgttcctttccacttttcgtgcttccttcaggagctcttgtaaggcaggcctggtggtgacaaaatctcacgtttgcttgtctgtaaagcagtttgtttctccttcacttatgaagcttagtttggctggatatgaagttctgggttgaaaattcctttctttaagaatgttgaatattggcccccactctcttctgacttgtagagtttctgccaagagatccactgttagtctgatgggcttccctttgtgggtaacccgacctttctctctggctgcccttaatattttttccttcatttcaactttggtgaatctgacaattatgtgtcttggagttgctcttctcgaggagtatctttgtggcgttctgtgtatttcctgaatttgaatgttggcctgccttgctaggttggggaagttctcgtggataataccctgcagcatgttttccaacttggttccattttccccgtcactttcaggtacaccattcaaatgtagatttggtcttttcacatagtcccatatttcttggagtccttgttcatttgtttttactctttttttctctaaacttctcttctcgcttcatttcgttcatttgatcttcaatcactgataccctttcctccacttgatcgaattgtctactgaagcttgtgcatgagtcacgtagttctcg

SEQ ID NO: 12804 - DNA, 5591 bp, Homo sapiens
ttttttgcagattccttagtgttttttttttttattatactttaagttttagggtacatgtgcacaacgtgcaggtttgttacatatatatatgtgtgccatgttggtgtgctgcacccattaactcgtcatttaacattaggtatatctcctaatgctatccttcccccctcctcccaccccacaacaggccctggtgtgtgatgttccccttcctgtgtccatgtgttctcattgttcaattcccacctacgagtgagaacatgccgtgtttggttttttgtccttgcgatagtttgctgagaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaccatacgtgtgcatgtgtctttatagcagcatgatttataatcctttgggtatatacccagtaatgggatggctgggtcaaatggtatttctggttctagatccctgaggaatcgccacactgacttccacaatagttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccgcttgttgatggagttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctaggatttttatggctttaggtctaacatttaaatctttaatccatcttgaattaattttagtataaggtgtaaggaagggatccagtttcagctttccacatatggctaggcagttttcccagcaccatttattaaatagggaatcctttccccattgcttgtttttctcaggtttgtcaaagatcaggtagttgtagatatgtggcattatttctgaggcctctgctctgtaccattggtctatatctctgttttggtaccagtaccatgctgttttggttactgtagccctgtagtatagtttgaagtcaggtagcgtgatgcctccagctttgctcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctctttcatttcatcaagcagtggtttgtagttctccttgaagaggtccttcacatcccttgtaagttggattcctaggtattttattctctttgaagcaattgtgaatgggagttcactcctgatttggctttctgtctgttattggtgtataagaatgcttgtgatttttgtacattgattttgtatcctgagactttgctgaagttgcttatgagcttaaggagattttggtctgagacaatgggattttctagatacacaatcatgtcatctgcaaacagggacagtttgacttcctcttttcctaactgaataccctttatttttttctcctgcctgatagccctggccagaacttccaacactatgttgaatagcagtggtgagagagggcatccctgtcttgtgccagttttcaaagggaatgcttccagtttttgtccattcagtatgatattggctgtgggtttgtcataaatagctcttattattttgagatacatcccatcaatacctaatttcttgagagtttttagcatgaagggctgttgaattttgtcaaaggccttttctgcatctaatgagataatcatgtggtttttgtcattggttctgtttatatgctggattacgtttattgatttttgtatgttgaaccagccttgcatcccagggatgaagcccacttgatcatggtggataagctttttgatgtgctgctggatttggtttgccagtattttattgaggatttttgcatcgatgttcatcaaggatattggtctaaaattctctttttttgttgtgtctctgccaggctttggtatcagaatgatgctggcctcataaaatgagttcgggaggattccctctttttctattgattggaatagtttcagaaggaatggtaccagctcctccttgtacctctggtagaattcggctgtgaatccatctggtcttggacttttttttggttggtaagctattaattattgcctcattttcagagcctgttattggtctattcagatattccagttcttcctggtttagtcttgggagggtgtatgtgtcaaagaatttacccatttcttctagattttctagtttatctgtgtagaggtgtttatagtattctctgatggtagtttgtatttctgtgggatcggtggtgatatcccctttatcatttttttattgcatctatttgattcttctctcttttcttctttattagtctagctagcggtctatccattttgttgatcttttcaaaaaaccagctcctggattcattgatttttttaaggggtttttgtgtctctatctccttcagttctgctctgatcttagttatatcttgccttctgctagcttttgaatgtgtttgctcttgcttctctagttcttttaattgtgattttagggtgtcaatttgagatctttcctgctttctcttgtgggcagttagtgctataaatttccctctacacactgctttaaatgtttcccagagattctggtatgttgtatctttgttctcattggtttccaagaacatctttatttctgccttcatttcgttatgtacccagtagtcattcaggagcaggttgttcagtttccatgtagttgagtggttttgagtgagtttctcagtcctgagttctagtttgattgcactgtggtctgagaggcagtttgttatagttacaatttctgttcttttacatttgctgaggagtgctttacttcaaagtatgtggtcaattttggaataggtgtggtgtggtgctgaaaagaacgcatattctgttgatttgggttggagagttctgtagatgtctattaggtctgcttggtgcagagctgagatcagttcctggatatcctcattaactttctgtctcattgatctatctaaggttgacagtggggtgttaaagtctccccttgttattgtgtgggagtctaagtctctttgtaggtctctaaggacttgctttatgaatctgggtgctcctgtattgggtgcatatatatttaggatagttagctcttcttgttgaattgatgcctttaccattatgtaatggccttctttgtctcttttgatctttgttggtttaaagtctgttttatcagagaccaggattgcaacccctgccttttttttgttttccatttgcttggtagatcttcctccatccctttattttgagtctatgtgtgtctctgcacatgagatgggtttcctgaatacagcacactgatgactctttatccaatttgccagtctatgccttttaattgggagcatttagcccatttgcatttaaagttaatattgttatgtgtaaatctgatcctgtcattatgatgttagctggttattttgcttgttagttgatgcagtttcttcctagcctcgatggtctttacaatttggcatgtttttgcagtggctggtaccggtcgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccaactctcctctggcttgtagagtttctgccgatagatctgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatgtgaatgttggcctgccttgctagattcaggaagttctcctggataatatccggcagagtgttttccaacttggttccattctccccgtcactttcaggtacaccaatcagatgtagatttggtcttttcacatagtcccatatttcttggaggctttgttcatttctttttattcttttttctctaaacttttcttctcgcttcatttcattcatttgatcttccatcactgataccctttcttccagttgatcgaattggctactgaggcttgtgcattcatcatgtagttctcatgccatggttttcagctccatcaggtcctttaaggacttctcagcattggttattctagttagcctttcatctaatcttttttcaaggtttttaacttctttgccatgggtttgaacttcctcctttagctcggagtagtttgatcttctgaaggcttcttctctcaactcgtcaaagtcattctccctccagctttgttccattgctggtgaggaggtgcattccttcggaggaagagaggcgctctgatttttagaattttcagtttttctgctctgttttttccccatgtttgtggttttatctacctttggtctttgatgatggtgatgtacagatggggttttggtgtggatgtcctttctgtttgttagttttccttctaacagtcaggaccctcagctgcaggtgggttggagtttgccggaggtccactccagaccctgtttgcctgggtatcagcagcagaggctgcagaacaatggatattggtgaacagcaaatgttgctgcctgatcgttcctctggaagttttgtctcagaagagtacccagccgtgtgagttgtcagtctacccctactgggggttgcctcctagttaggctacttgggcatcagggacccccctgaggatgcagtctgtccattctcagatctcaagctgcatgctgggagaaccactactctcttcaaagctgtcagatagggacatttaagtctgcaggatttctgctg

SEQ ID NO: 12805 - DNA, 4878 bp, Homo sapiens
gccatgttggtttgctgcaccctttaactcgtcatttacattaggtatttctcctgatgctatcccttaccctgtcccccagcccacgacaggccccagtgtgtgatgctccccgccctgtgtccaaatgttctcattgttcaattcccacctacaaataagagcatgaggtgtttggttttctgtccttgtgatactttgctcagaatgatggtttccagcttcatccatgtccccacaaaggacatagcctcatccttttttatggctgcatagtattccatggtgtatatgtgccacattttcttaatccagtctatctttgacggacatttgggttggttccaagtctttgctattgtgaatagtgcttcaaaaaacatacatgtgcatgggtctttatagtagcatgatttataattctttgggtatatacccagtaatgggatcactggatcaaatggtatttctagttctagatccttgaggaatcaccgcactgtcttccacaatggttgaattagtttacactcccaccaacagtgtaaaagcgttcctatttctacacatcctctccagcacctgttgtttcctgactttttaatgatcaccattctaactagtgtgagatggtatctcattgtggttttgatttgcatttctctgatgaccagtgatgatgggcattttttcatgtgcctgttggctgcataaatgtcttcttttgaaaagtgtctgttcatatcctttgtccactttttgatggggttgtttgatttttttcttgtaaatttgtttaagttctttgtagattctggatattagccctttgtcagatgagtagattgcaaaaattttctccctttctctaggttgccttttcgctctgatgatagtttcttttcctgtgcagaagctcttgagtttaattagatcccttttgtcaattttggcttttgttgtcattgcttttggtgttttagtcatgaggtccttgcccatgccaatgtcctgaatggtattgcctaggttttcttctagggtttttatggttttaggtctacaatttaagtgtttaatccagcttgaattaatttctgtataaggtgtaaggaagggatccagtctcagctttctacatatggctaaccagttttcccagcaccatttattaaatagggaatcctttccccattgcttgtttttgtcaggtttgtcaaagatcagatagttgtggatgtgtagtgttattactaagggctctgttctgtttcattggtctatatctctgttttggtaccagtaccatactgttttggttactttatccttgtagcatagtttgaagtcaggtagcctgatttctccagctttgttccttctccttaggattgtcttggcaaggcaggctcttttttggttccatatgaactttaaagtagtttcttccaattctgtgaaggaagtcattgggagcttgatggggatggcattgaatctaaaaattgccttgggcagtatggccattttcacaatattgattcttcctatccatgagcatggaatgtgcttctatttgtttgtgtccttttttacttcgttgagcagtggtttgtagctccccttgaagaggtccttcacatcccttgtaagttggattcctagatattttattctctttgtagcaattgtgaatgggagttcactcatgatttggctctctgtttgtctgttattggtgtgtaagaatgcttgtgatttttgcacattgattttatatcctgagactttgctgaagttgcttaccagcttaaggagattttgggctgagatgatggggttttctagatatacaattatgtcatctgtaaacagggacaatttgacttcctcttttcctaattgaataccctttatttctttctcctgcctgattgccctggccagaacttccaacactatgttgaataggagtggtgagagagggcatccctctcttgtgccagttttcaaagaaaatgcttccagcttttgcccattcagtatgatattggctgtgggtttgtcataaatagctcttattgttttgagatatgtcccatcaatacctaatttattgagagtttttagcatgaagggctgctgaattttgtcaaaggccttttctacatctactgagataatcatgtggtttttgtccttggttctgtttatatgctggattacgtttattgatttgtgtatgttgaaccagccttgcatcccagggatgaagcccacttgatcatggtggataagctttttgatgtgctgctggattcggtttgccagtattttattgaggacttttgcatcgatgttcatcagggatattggtctaaaattctctttttttgttgtgtctctgccaggctttgttatcaggatgatgctggactcataaaatgagttagggaggattctctctttttctattgattagagtagtttcagaaggaatggtaccagctcctccttgtacctctggtagaattcagctgtgaatccatctggtcctgaacttttcttggttggtaagctattaattattgcctcaatttcagagtctgttattggtctattcagagattcaacttcttcctggtttagtcttgggagggtgtatgtgtccaggaatttatccgtttcttctagattttctatgcaaataagcatagaggtgtttatagtattctctgatggtagtttgtatttctgtgggattggtggtgatatcccctttatcattttttattgcgtctatttgattcttctctcttttcttctttattagtcttgctagcagtctatcgattttgttgatctttaaaaaaaaaaccagctcctggattcacagattttttgaagggttttttgcgtctctatctccttcagttctgctttgatcttgttatttcttgccttcggctagcttttgaatgtgtttgctcttgcttctctagttcttttaattgtgatgttagggtgtcaattttagatcttttctgctttcacttgtgggcatttagtgctgtacttttccctctacacactgctttaaatgtgtcccagagattctggtatgttgtgtctttgttctcattggtttcaaagaacatctttatttctgccttcatttcgttatttaccccgtagtcattcaggagtaagttgttcagtttccatgtagttgtgtggttttgagtgagtttcataatcctgagttctaatttcattgcactgtggtctgacagacagtttgttatcatttctgttcttttgcatttgctgaggagtgcttcacttccacctatgtggtcaattttggaataagtgcgatgtggtgctgagaagaatgtacattctgttgatttggggtgaagagttctgtagatgtctattaggtctgcttgttgcagagctgagttcagttcctggatatccttgttaaccttctgtctcgttgatctgtctaatgttgacagtggggtgttaaagtcttccattatcattgtgtgggagtctaagtgtctttgcaggtctctaagggcttgctttatgaatctgggtgctcctgtattggatgcatgtatatttaggatagttagctcttcttgttgaattgatccctttaccattatgtaatagccttctttatctcttttgatctgtgttggtttaaagtctgttttatcagagactaggattgcaacccctgttttttgtttgtttgtttgttgtttgttttgttttgtttttttgtttttttgctttccatttgcttggtagatcttcctccatccctttattttgagcctatgtgtgtgtctctgcacgtgagatgggtctcctgaatacagcacagcaatgggtcttgactctttatccaatttgccagtctctgtcttttaattggggcatttagcccatttacatttaaggttaatattgttatgtgtgaatttgatcctgtcattgtgatgttagctggttattttgcctgttagttaatgcagtttcttcctagcattgatggtctttacaaattggcatgtttttgcagtggctgttaccagttgttcctttccatgtttagtgcttccttcaggagctcttgtaaggcaggcctggtggtgacaaaatctctcagcatttgcttgtctgcaaaggattttatttctccttcacttatgaagcttagtttggctggatatgaaatcctgggttgaaaattcttttctttaagaatgttgaatattggcccccactctcttctgacttgcagcgtttctgctgagatatccactgttagtctaatgggcttgcctttgtgggtaacctgacctttctctctgggtgcccttaacattttttccttcatttcaacctcggtgaatctgacaattatgtgtcttggggttgctcttctcgaggagtatcattgtggtgttctctgtatttcctgaatttgaatgctggcctgccttgctaggttggggaagttttcctggaaaatatcctgaagagtgttttccagcttggttccattctccccgtcactttcaggtacaccaatcagacgtagatttggtcttttcacatagtcccatatttcttggaggctttgtttgtttctttttactcttttttctctaaacttctcttcttgcttcatttcattaatttgatcttcaatcaccattaccctttcttccacttgatcgaatcggctactgaagcttgtgcatgtgtcacgtagttcttgtgccatggttttcagctccatcaggtcatttaaggtcttctgtacagtgtttattctagttagccattcatcta

SEQ ID NO: 12806 - DNA, 5579 bp, Homo sapiens
tttctcttttttttcttagtctagtttaggatttttttaaaattttattattattatactttaagttttagggtacatgtgcacaaagtgcagatttgttacatatgtatacatgtgctgttggtgtgctgcacccattaactcgtcatttagcactaggtatatctcctaatgctatccctccccctccccccacccatgacaggccccggtgtgtgatgttcccctttctgtgtccaagtgttctcattgttcagttcccacctatgagtgagaacatgcagtgattgatttttcgtccttgcgatagtctgctaagaacgatggtttccagcttcgtccgtgtccctacaaaggatgtgaactcatccttttttatggctgcatagtattccatggtgtatatgtgccacattttcttaatccagtgtatcattgatggacgtttgggttggttccaagtctttgctattgtgaatagtgccacaataaacatacgtgtgcatgtgtccttctagcagcatgatttataatcctttgggtatatacccagtaatgggatggctgggtcaaacggtatttctatttctagattcttgaggatttgccacactattttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcacttctctgatggccggtgatgatgagcattttttcatatgtctgttggctgcataaatgtcttcttttgagaagtgtctcttcatatccttcccccacttgttgatggggttgtttggttttttcttgtaaatttgtttgagttcttagtcgattccggatattagccctttgtcagatgagtagattgcaaaaattttctcccgttctgtaggatgcctgttcactctgatggtagtttctttagctgtgcagaaactctttggtttaataagatgccatttgtctattgtggcttttgttgccattgcttttggtgttttagacatgaagtccttgcccatgcctgtgtcctgaatggtattgcctaggttttcttctaggctttgtatggtttaacctctaacatttaagtcgttcatccgtcttgaattaattttcgtataaggtgtaaggaagggatccaatttcagctttcgacatatggctagccagttttcccagcaccatttattaaatagggaatcctttccccatttcttgtttttgtcaggtttgtcaaagatcagatggttgtagatgtgtggtattatttctgagggctctattctgttccattggtctacagtaaccaaaacagcaaccaatagcatgctgttttggttgctgtagccttgtagtgtagtttgaagtcaggtagcctgatgcatccagctttgttcttctggcttaggatcgtcttggcaatgcgggctcgtttttggttccatgtgaattttgaaggagtttttccaactctgtgaagaaagtcattggtagcttgatggggatggcattgaatctataaattaccttgggcagtatggctattttcacgatattgattcttcctatccgtgagcatggaatgttcttccatttgttttcgtcctcttttatttcatggagcagtggtttgtagtcctccttgaagaggtccttcacatcacctgtaagttggattcctaggtattctattctctttgaagcaattgtgaatgggagttcactcatgatttggctctctgtttgtctgttagtggcgcataagaatgcttgtgatttttgcacattgattttgtatcctgagactttgctgcagttgcttatcagcttgaggagattttgggctgaggcgacggggttttctaaatattcaatcatgtcatctgcaaacagggacaatttgacttcctctttccctaattgaataccctttatttctttctcctgcccgattgccctggccagaacttccaacactatgtcaaataggagtggtgagagagggcatccctgtcttgtgccagtttgcaaagggaatgcttccagtttttgcccattcagtatgatattggctgtgggtttgtcataagtagctcgtattattttgagatacgtcctatcaatacttaacttattgagggtttttagaacgaagggctgttgaattttgtcaaaggtcttttctgcatctattgagataatcatgtggtttttgtctttggttctgtttctatgctggattatgtttattgatttgcgtatgttgaaccagccttgcatctcagggatgaagctcacttgatcaagttggataagctttatgatgtgctgctggattagggttgccagtattttattgaggattttgcatcagtgttcatcagggatatttgtctaaaattctctttttgttgtgtctctgtcaggatttgatgtcaggataatgctggcctcataaaacgagttagggagaattccctctttttctattgattggaatagtttcagaaggaatggtaccaactcctccttgtacctctgttagaattcggctgtgaatccttctggtcctggactttttttggttggtaggctattaattattgcctcaatttcagagcctgttattggtctattcaaggattcaacttcttcctgatttagtctggggagggtgtatgtgtctaggaatttatccatttcttctagattttctagtttatatgcatcgaggtgtttataggattgtctgatggtagtttgtatttctgtgggatcagtggtgatatcccctttatcattttttattgcatctatttgattcttctctcttttcttctttattagtcatgctagcggtctatcaattttgttgatcttttccaaaaaccagctcctggtttcatcgattttttgaagggctttttgtgtctccgtctccttcagctctgctgtgatcttagttatttcttgccctctgctagcttttgaatgtgtttgctcttgcttccctggttcttttaattgtgatgttagggtgtccattttagatctttcctgctttcccctgtgggcatttaatgctataagtttccctctacacactgctttgaatgtgtcccagagattctggtatgttgtgtctttgttctcattggtttcaaagcacatctttattctgccttcatttcgttatgtacccagtagtcattcaggagcagattgctcagtttccatgtagttgagcggttttgagtgagtttcttaatcctgaggtctagtttgattgcactgtggtctgagagaccatttgttgtaatttgtgttcttttgcatttgctgaggagtgctttccttccgactatggggtcagttttggaataagtgtgatgtagtgctgagaagaatgtatattctgttgatttgaggtggagagttaatgtggatgtctattaggtctgcttggtgcagagctaagttcagttcctggatatccttttcaactttctgtctcgttgatctgtctaatgtggatggtggggtgttaaagtctcccattattattgtgtgggagtctaagtctctttgtagttcactgaggacttgctttatgaatctgtgtgctcctgtattgggtgcatatatatttaggatagttagctcttcttgttgaattgatccctttaccattatgtaatggccttctttgtctcttttgatctttgttgttttaaagtctgttttatcagagaataggattgcaacccctgcctttttctgttttccatttgcttggtaagtcttcctccatccctttattttgggcctttgtgtgtctctgcacaggagatgggtttcctgaatacagcatactgatgggtcttgactctttatccgatttgccagtctgtgtcttttaattggagcatgtatcccatttacattcaaagttaatatcgttatgtgtgaatttgatcctgtcattatgacgtcagctggctactttgcttgttagttgatgcagtttcttcctagcctttttggtctttacaatttggcatgtttttgcagtggctggtaccggttgttcctttacatgtttagtgcttccttcaggagctcttttagggcaggcctggtggtgacaaaatctctcagcatttgtttctctgtaaagtattttatttctccttcacttatgaagcttagtttggctggatatgaaattctgggttgaaaattcttttctttaagaatgttgaatattggcccccactctcttctgtctcgtagagtttctgctgagagatcagctgttagtctgatgggcttcctttgtgggtaacttgacctttctctctggctgcccttaacgttttttccttcatttccactttggtgaatctgacaattatgtgtcttggagttgctcttctcgaggagtatctttgtggtattctctgtatttcctgaatttgaatgttcgcctgccttgctagattggggaagttttcctggataatatcctgcagagtgttttccagcttggttccattctccctgtcactttcaggtacaccaatcagacgcagatttggtcttttccatagtcccatatttcttggaggctttgttcgtttctttttaatcttttttctctaaacttctcttctcgcttcatttcattcatttcgtcttccatcactgataccctttcttccagttgattgcattggctactgaggcttctgcattcttcacgtagttctcgtgccttggttttcagctccttcaggtcctttaaggacttctctgcattggttattctagttatccatttgtctaatttttttaaaagtttttaacttctttgccatttgtttgaacttcctcctgtagcttggagtagtttgatcctctgaagccttcttctctcaactcgtcaaagtcattctccgtccagctttgttccactgctggtgaggagctgcgttcctttggaggaggagaggtgctctgatttttagagtttctagtttttctgctctgttttttccccatctttgtggttttatctacctttggtctttgatgatgttgacatatagatgggtttttggtgtggatgtccttcctgtttgttagttttccttctaacagacaggaccctcagctgcaggtctgttggagtttgctagaggtccactccagaccctgtttgcctgggtatcagtagcagtggctgcagaacaacggatattggtgaaccgcaaatgctgctgcctgatcgttcctctggaagttttgtctcagaggagtaccggccgtgtaagctatcagtccgcccctactggaggatgcctcccagttaggctactcggggttcagggacctacttgaggaggcagtctgcccattctcagatctcaagctgcatgctgggagaaccactgctctcttcaaagctgtcagagagggacattt

SEQ ID NO: 12807 - DNA, 21927 bp, Homo sapiens
  misc_feature (13866)..(13866): n equals a,t,g, or c
ccgccatagctccccagcagaaacccggaagtggaaatctcagccattcagtgtttgggtgaagacggaggcgggttctggacagacctacgctgtcggggagtgtttacttcgcctccacttctgttcctccccgccctggtgctgctccaggtcacatactcttcctgagccggcttcagcctctccgcgcagaagtctcccggagccatggcctagtattcttatgtgaagtctaccaagcttgtgctcaagggaaccgaggtgaagagctgggtcctgcagctccggcgggagcctcctcagttcttttcggacgcactccacccccgcgaatccggtggaagccgtgatgcggagagccggcttcgtggcctcccaggcttcgctctgaccctgtctgggctggatggaggccggaccgcccttcctggcgcctgtgcagagaggggcagcctcctgcgcggacgaccctggaaacaggatagacgggcgggtgacccgtgaccccgtacccacgagtttgggtcccttgaggcatctctccaggcctctgcctggtgggtctgcgttagtctgatcttgtagttcattataataacttcctttattaggaattattcttttctccattgtctcttcctggaaaaattattaatttttttctaagctaatatgtagagtgaaaccaggatgaatcacacagtggttgaggtgtatatggactttgatagggatatgggctggaacctgcactctgtcatttactaattttgtaatttgtggcaaattggttaatatgtctgaacttccatttactcattaagagatcaagtatctttgaacctccgtttacacatttatactttcagaccattttttatacctttagaagactgtgaggattaaatgagagaacatacatgcagtaaataaattgagccaaatgtgaggaggaggttgtagtggtaatttattagctctttaggagaaaaatacctgtgcattcatatccccgcttcttttttaactggcagatttgcctgaggttgactgtacatgcaaatattgagctttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcaggtatatcctgaatgaatgtgagatttttactctgtgaatttcctgtgaggagtggtgagttatcttctgaaaactttatgatgaaaatgcagacaagagtatcttaagattatcgtaataatcataattaatgcttatatagcactttcaatgcgccaagaaattgtaggcattttgcacattaacttttttcaaatccctcttgggtttttatttttttattgcgatgtaattcataattataaaattcacccttttgtacagtcagtggtttttagtatatatccaagaggttcaccactgtctagttgctcagcatttttgtcatctcaaaaggaaatctcttcctacccattaaagctgtcacatcccatcttccccctctcctagtccatggcaaccactagtctgctatctatgtgaaattgcctattctgaatatttcctaagaaatcatgtaacatgtggccttttgtatctggcttctttcacttacaacattcttgaggtccatcattgttgtagcacttgttcctttttatggctgcgtagtgtagtccattgtatggatgtaatattttgttcatccattcatcagttgatgaacatttagattgtttcccctttttgactattgtgactaatgctagtgtgaatattcttatgtaagtatttttgtgggtgtacgttttcatttcccttgggtatacatacttaggagtaaaattgctgggtcatatggtaactctttaactttttgaggaaccccaaactgtttcctgtagatgctgcaccattttacatttccaccagcaatgtgtgaagatacatattacctcttaatcctcacaatagacttaagagttaagttgttatcctaattttttaagtggggaaactgactcacagagagattcagtaccttttccaaaaattgcagagctaagaagtgacagaatcgggatttaaaatctggcggtgtggctctacaatctgctttgaactttaacataatatgtacaaagcctgaagcaaattctcagtactgtatttaagagggcatagcaatgtaagtcttcctaaatcaataatttataaatgaaacaacttaaaagacttccaagtttcaatcttacgatatttatttatcacacaaatcaatatacttaaactcatctatataaattatttcctgtagtaagaagaaaaagagcaaagataagaagagaaaaagagaagatgaagaaacccagcttgatatgttggtgagtcagttttcagtgctttattctgaaaaaagttaacatttcttgagatctcattgaaaatattttcctagttagaaatttatgatgtattcatatttgtcttaaagtgcttaaatattgcctacagttgtaaattccatttattctttagcacagtagatgctactgatgcctttacttcattatcagaacagagcacaggagagaagaattacaacactctgacttagtaggcaccattagactgcttaatagccggagattctgatacataattttaaaggcttaatgtaaatgttattcaaccaaatatattttacaagctattttctttgaacatctgtacattttagttgtagaagtcagttgtctcttaaacgaagtatcttcacaggaaaaatcattattttgtgaactctgaaatgaatgaaaattttaaatacaatatcagggtggcctgtaaatgatactagaaataaactgacccaaacacacttaaccagcctgttttccgtttagctgtttccatacttttttttcttttttaaaacttggcaagttgcattttgaatcttcataaattatggtagcttaaaaaatatataaaatatggaatggtgtaaagctaatgttctggaagatcattgcttttgaaatggcaaatcaacaattctaaaattagggtaaatatctagggtagatatgtagatgtggaattgctgtgtcaaaggatagttgaatgtttaactatataagaaactgtcaaaaattttctaaagtggttgtgctattttatcctcccaacaagaatgaattagttctccagttacatccttgccaagagttgatggtgttatcagtcttttctcccagtctgagttttaccttttcagtttcttaatggtggtttttggatggacagcttttttttttttttttttttgagatggagtcttgctctgtcacccagactggagggcagtggcgcaatcttcgttcactgctaggtccacctcccaggttcacgccattctcctgccttagcctcccaagtagctgggactacaggcacctgccaccacgcccagctaattttttgtgtttttagtagtgacagggtttcaccatgttagccaggatggtcagaagcttttaatttttataaagcttagtttatttttttttcttttatggttactgccttatctctttgatctaagagatctttgcttaccccaaagtcaggaagatattctacattgtcttttagaggcatcatagttttagtttttacattaaatctgtcattaatctcaaattaatttttggcatggtgtgagtttggtttcaagatttacttttttttttttttaacatcttgatagccatttgtgccagcaccactggtgtttcctttttccattaatccagtttcatatcttcataaaaagtcaattaactttctatgtattggtctatttctggactctgttctatcgattgtctgtttttcttttggtatatttctcttgattgctataatttcatgaagtcttgagatcaggtagtgtgtgtcctccaactttgtacttactattagtttattaatttctacagtgaagcctgttggattttctcggagaattgtattgagtccagatcatttgggggagaatcaacatcttaatattgggcctcaatatttcataattttcaatgtagcagtcttgcatgcctgtttaaaaatttattcttaagtattttataattttacattactgtgtagaacttttgaatttgactttccagttgtttgctgtcagtatgtagatatacaattgatttttgtatagtgactttatagtctgataagtctgtttcacttattacttctagtggtttgtttatatagaaaactaagaaatttgcaattatgtttcctgtgactatcattttacttctttctttcgaatcttaatgtcttgtcttgctttttattggtttattatactgtccaggacttccatagtgttgaacagaagtcacgagaatgggcataattgcattgtttccaagcttaggcagaaaggtttcagtagtccaccatatggtatgatgtctgtacgatctacagagaaaacctttatcaaaatgaggacattccttttaaactttgtttctcggcagtttttatcataacgatgtttaatgctgtcaaatgtctccttctgtatctgttgagatgattatacaactttcttcattctgccagtgaattacattggtttcattttcaacttttaaactaactttacatccctgagataaaccccacttggttgtggtgcattgtcctttggaatattgctagagttgatttctaggttttttttttttttttaagatttctatattggtgttgatggagatattggacttttgtatccttttcttgtaatgtctttatttgattttggtgtcaaggtgatattgggtgtcataaaattagatgggaagtgctgtctccttccctgtttttggaaatagctgtgtaagataggtatgatttcttctttacatgtttgataggatttaccagtgaagtcatctgaacctagagggttttgtttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttctaatgtctgtagaatctaatctgtattgcagtctcttcatattggtaatttgtgttttttctattttttcctggatcagtcagtctagctggagatttatcaattctttataagatcacttattttagatcattaatgatcttttagtacaggggtattcactcttttagcttccctgggccacaacggaaggagaagaattgtcttgggccacacataggatacattaacgataagctgatgagccaaaaaaaaggaaaaaaaatctcataatgtttcaagaaagtttacaaatttgtgttgggctgcattcaaacctggcctgggccacatgcagccctcaggttggacaagcctgtttcagtattacttattttctttttttcattttttatttcatttattttcagtctttttttttcctccctttaacttattttcagtttactttgctcttgttttattgcttcttaagaagagagttagatctcttcattccacgttagttttagttatagtcaacacattttgctttcgttttcattccattcaaaatatcatctagttttccttgtgatttttcttttcatggacacttgagttatttaaaagtgtattttttttaatttctactacatagagatattataggtatgttattgttgctgatttctaattcatttatagtatagttggagaacatacattcttagtgaatttccatgtacacttgaaaagaatgtgtattctgtagatgttggttcagggtttttttttttttttttttttttggagatgaagtcgcactctgttgcccagcaggctggagtgcagtggaacgatctccgctcactgcagcctccgcctcccaggttcaagtgattctcctgcctcagcctctggaggagctggaattacaggcacctgccaccacgcctggctaatttttttaatatttttaatagaggcggggtttcaccacgttggccaagctggtctcaaactcctgacctcaggcgatccacccgcctcggcctcccaaagtgctgggattacgggcgtgagccgtggtgcccggtggttcagtgttctttagatgtcagttagatcaactggtggagcttgtgactatgcacatcttctgtgtccttactgattttttactcatcctacaatgtattgagagttatgttaaaatctccagctgtaattctagatctgtctacttgagcagtttttgcttaaagtattttgaagctgtcatgtgtacgcatttaggattgttaattcttccttataaattcagtctttcattttcataacattttaacctttatttctgttaaatgtcttgatgcctagttatattatttgaccacccttttgctcctgtcaagcctgggcctttgttagtttgtgcttatttattaggtttttgcctgtagacttagacagtgactcttactctaggaaaggttcatcctcatgggcctcagccacatgttctaggtatacttgatgagttctctccactctgctatgtcccaaatttgtgtgctctctggcatctccagtcagccctcagaagtgccagccactctgcagaggccttgtggagcctgcctgctgtatgcactccccccagcccttggccccagacctgcagagaacttttgcattctcttttgaggcctcacctgtatgtagttccctcttctccagtaccttattctatgaactccaaacacgttagcactgcaagactctcagcttagtgacagtgacattgcctcatttttggaggtctctacctctctctgtgtggtcgagaaactgccattgggcagaaaacagaagtgtgtgtgagatttgcctcctgtgttttcctgttctcaaatatcacagtcctgttctgcctgtgttccaatccctgaaaacagttttctcaaatattctatccagcttcagtcgttggtcatggtgggagggcaagttcatcttggctggaagaggaagtccttctgcgtctttttctccttgtccttccaccttcttttgcattgtggattttctaaacttgccatataagtaagcatgtgcctatttgtgaagggaaagaaaaaacccttttaattttttgaagctgttctgttggttcctcacaaggatctgaagggattggtaaataggatgaaagaaattctgtctttcacatggagaataccgtgtgtgacattaataaaaatgagcatgtctgtaagcaaagagtttcactgagctctgctagaatcagaagcaactgaacttacatcgtagtttgcaaaacacagatttgatttacccaggaactaaagctgagtaagctatgggttaatagaaggtctgtgaagggtacttagactacagtaagattggggaagaaaattccatttccaaatctaagatatatcattcctttgtgccaagcacataatgaaggtagaggtttaagggggcccttagcacagaagcactgggttagtcagaaggtgaggtgagctgtcacacagccttgatgctagaatgagggtgccctgatagtgtcttatcagccatgacactggtgcatcgggccaggtttgtttttttttcttttttttgagacaggctgttgctttgttactcaggctagagtgcagtgacacgatcatggctcagtgcacccttgacctcgtaggctcaagcaatcctctcacctcgaactcccgagtagctgggaccacagtcttgtaccaccatacccagctaatttcttaatttttttgtagagatgggggtctccttttgttgcctaggctgattttgaactcctgggcttaagtgattctcctgcttccacctctcaaagtgctggattacaggcatgccagacatatggaaacattctcaactatctgaaaatacgtgaaaagctttgttatgcattgtgagacaatacagcaggaatatttcaccatctgcctaaggtttaaaaggaaataactttaagcatgtgtctaaataggaagtaatgttttagagcggattctcttaaattcagcttgtgcgtctgcagcatatacacagcttgagctgtaacctgacatagagacaggcaacttcagtgcccactgttcttaggatccactgctttttcacagctaaaacccctgagtggcactgttaagtattatgttatgttactttagtcgttaaacgtataagcatacctccaaaggttgaatgtaggccacttgcagaaagtaggcagaatgctcacatttaattcttgataatactgtgtttagctttcttattctttgaaatctcattgagaagaaatactggcatctgttcaaagtaatttctttttcagttgacaatattataagtaatgttattgtatcatttccctacttggacagagtgtgaaaattttgaggagcttgtctgccagaaatttcttcttcatttgcaaaacattaatgagatattatatttaaataattttgtttaatattaagtgtacttggtgaatgtggcatagaacatacaaaataaaactaatttaaaattattaactattacatttataagaaagacttgctaatcataacactgttgataatgattctgaataaagcattatttcttttcctgaaaacaattgtagctataactcaatcatctaaattgcttattagttttatttctttttaattgtctattttgattaattttctttttctccattggtttcgtgtgtttgtggaggtaaaatatacagaatatagaatttgccagtttttctatttttacgtgtacacttcagtggcatttaaatacatgcaccattttaccttcccaccagcattgcacagggtttcagtttctccacatcctgcccaacatttgtttttctggttttcttgatttctgttttttatttgttttgataatagcattctaatgggtgtgaagtggtattgcattatggttttgatttatatttccctagtgactagtgaagttgagcgtcttttcgagtgcttattggccatttgtatatcatctttggagcaatgtccgtatatatcctttgcccagttttgaattgtggtatttgtccttttggagttctctacatagtctggatattaattccttataatgtatgtagtttacacatattttctccattctctgggttgccttttattctgacagtggttcttgatgcacaaaagtttttaattctgatgaagtccagtttgtctgtgttttcttttgttgcctgtgcctttgatgttctatataagaaatcattgccaaattcattgtcgtgaagctttttccatcttattctaaaagttttctaactttagctcttacatttaggtctttggtctattttaagttactttttgtatttggtgttagataagggtccaacttcattttagctaaaattttatgtattttaaaattgattatgaaaagcatgaaatgtttagttgaatagaaaattttgtgcagtggaattaactgaatctttaaaacctttttattatggaaatatccaaactaatccatacatagaagaatataatgagtcccccatgtgcccaggccccagcattaattatcaatattttgccaatttcgtttcatttacatacacacccccacacacgttttttcctaaaaaattttaagtaaaatcacagatattacatcattttatccataagtacataaatggacatttcttttttatttatttatttttttattattatactttaagttttagggtacatgtgcacattgcgcaggttagttacatacgtatacatgtgacatgctggtgtgctgcacccactaactcatcatctagcattaggtatacctcccaatgctatccctcccccctccccccaccgcacaacagtccccagagtgtgatgttccccttcctgtgtccatgtgatctcattgttcaattcccacctatgagtgagactatgcggtgtttggttttttgttcttgcgatagtttactgagaatgatgatttccaatttcatccatgtccctacaaaggacatgaactcatcattttttatggctgcatagtattccatggtgtatatgtgccacattttctgaatacagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaaaggtatttctagttctagatccctgaggaattgccacactgacttccacaatggttgaactagtttacagtcccaccaacagtgtaaaagtgttcctatttctccacatcctttccagcacccgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgccctttgtccactttttgatggggttgtttttttcttgtaaatttgtttgtgttcattgtagattctggatattagccctttgtcagatgagtaggttgtgaaaaatttctcccattttgtaggttgcctgttcactctgatggtagtttcttttgctctgcagaagctctttagtttaattagatcccatttgtcaattttggctttggttgccattgcttttggtgttttagacatgaagtccttgcccatgcctatgtcctgaatggtaatgcctaggttttcttctagggtttttatggttttaggtctagtgtttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattgatctatatctctgttttggtacctgtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcagtttgtagttctccttgaagaggtccttcacatcccttgtaagttggattcctaggtattttattctgtttgaagcaattgtgaatgggagttcactcatgatttggctctctgtttgtttgttgttggtgtataagaatgcttgtgatttgtgtacattgattttgtatcctgagactttgctgaagttgcttatcagcttaaggagattttgggatgagatgatggggttttctagatatacaatcatgtcatctgcaaacagggacaatttgacttcctcttttcctaattgaataccttttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctgttgagataatcatgaggttttgtctttggttctgtttatatgctggattacatgtattgatttgcatatattgaaccagccttgcatcccagggatgaagcccacttgatcttggtggataagctttttgatgtgctgctggattctgtttgccagtattttattgaggatttttgcatcaatgttcatcaaggatattggtctaaaattctcttttttggttgtgtctctgcccggctttggtatcagaatgatgctggcctcataaaatgaattagggaggattccctctttttctattgattggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttacagtattcactgatggtagtttgtatttctgtgggatcggtggtgatatcccctttatcattttttattgcgtctatttgattcttctctcttttcttctttattagtcttgctagtggtctatcaattttgttgatcctttcaaaaaaccagctcctggattcattaattttttgaagggttttttgtgtcactatttccttcagttctgctctgattttagttatttctttccttctgctagcttttgaatgtgtttgctcttgcttttctagttcttttaattgtgattttagggtgtcaattttggatctttcctgctttctcttgtgggcatttagtgctgtaaatttccctctacacactgctttgaatgcgtcccagagattctggtatgttgtgtctttgttctctttggttttaaagaacatctttatttctgccttcatttcattatgtaactagtagtcattcaggagcaggttgttcagtttccatgtagttgagtggttttgagtgagattcttaatcctgagttctagtttgattgcactgtggtctgagagacagtttgttataatttctgttcttttacatttgctgaggagagctttacttccaagtatgtggtcaattttggaataagtgtgatgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagtgagctcttcttgttgaattgatccctttaccattatgtaatgaccttctttgtctcttttgatctttgntggttgaaagtctggtttatcagagactaagattgcaacccctgccttttttttttgttttccatttgcttggtagatcttcctccatccttttatgttgagcctatgtgtgcctctgcacatgagatgggtttcctgaatacagtacactgatgggtcttgactctttatccaatttgccagtctgtgtcttttaattggagcatttagtccatttacatttaaagttaatattgttatgtgtgaatttgatcctgtcattatgatgttagctggttattttgctcgttagtttatgctgtttcttcctagtctcgatggtcattacattttggcatgattttgcagcggttggtactggttgttcctttccatgtttagtgcttccttcagaagctcttttaggcaggcctggtggtgacaaaatctctcatcatttgcttgtctgtaaagtattttatttctccttcacttatgaagcttagtttggctggatatgaaattctgggttgaaaattcctttctttaagaatgttgaatattggcccccactctcttctggcttgcagggtttctgccgagagatccgctgttagtctgatgggcttccctttgagggtaacccgacctttctctctggctgcccttaacattttttccttcatttcaactttggtggatctgacaattatgtgtcttggagttgctcttctcgaggagtatctttgtggcgttctctgtatttcctgaatctgaacgttggcctgccttgctagattggggaaattctcctgaataatatcctgcagagtgttttccaacttggttccattctccccatcactttcaggtataccaatcagacgtagatttggtcttttcacatagtcccatatttcttggaggctttgctcgtttctttttattcttttttctctaaactttccttctcgcttcatttcattcatttcatctgccattgctgataccctttcttccagttgatcgcatcggctcctgaggcttctgcattcttcctgtagttctcgagccttggttttcagctccatcagctcctttaagcacttctctatattagttattctaactgggaggcaccctccagcaggtgcacactgacacctcacactgcagggtactccaacagacctacagctgagggtcctgtctgttagaaggaaaactaacaaacagaaaggacatccacacaccaaaaacccacctgtacatcatcaccatcatcaaagaccaaaagtagataaaaccacaaagatggggaaaaaacagaacagaaaaactggaaactctaaaaatcagagcgcctctcctcctccagaggaacgcagctgctcaccagcaacggaacaaagctggacggagaatgactttgaagagctgagagaaggcttcagacgatcaaattactctgagctacgggaggacattcaaaccaaaggcaaagaagttgaaaactttgaaaaaaataaatgtacattaattaacgtggtatgtctttctctcatcacctgttttgttctttacttttatattatactatgtcattatcagaccttgtaaaattaacaagaattccttaatatgtcatatccagttaatgattgactcatttctactctagttaaggtacaaattaggaggaggtttgaggatattttttaacattaagatataaacttttataacaactgctaaaataattgttgctagagtctaacatttatattggcaaattggacattagtatacataggcatagattctgctcattttgctttcaatctaaaatcatagttaagattactggctgggcgcggtggctcacacctgtaatcccagctctttgggaggcagaggcgggtgaatcacgaggtcaggagttcaagaccagcctggccaatgtggtgaaaccctgtctctactaaaaatacaaaaaaaattatttgtgcatggtgacaggctcttgtaaccccagctactcgggaagctgaggcagagaattgtttgaacccaggaggtggaggttgcagtgagccaagatcgcatcactgcacttcagcctgggcaacagagcgagactccatctcaaaaaaaataaataaataaaaattactatgctagaaagtcttcctgtagaggcatttttaagaagcattatgataggcattgcctctggaaagcaggcatgaatagatggctggggtctatcatgagagagaccgttctccatatatcactttgtaccttcatatgttgccttttgttttagtttggtttttttttgagacaggaccttgctctgtcactcaggctagagtgcagtggcatgatcatagctcactataaccttgaactcctgggctcaagtgatcctctttcacagctccccgagtagttgggattacaggcatgcacccccatgcctggctgtatgttgctattgtgtattttaaaaacctaatcctgactgtgctggtagtcgcatgaatctgtgcacatacgtgcaaacaagtacatgtaaaactggtgaaatctgaataagcttcatggattatatcaatgtcagtttccggattctaacaatgtatgatacttatgcaagatgttatcactgagacaaagcgagtaaaggatatgtgagatcttcatagtatttcttacgactgcaaaataaaaagtttttaaaactcagttacaataacaaagaactctgtgtcaaaactaaaatataaagttgaaatatcaattttattttttaggaatctggtgaacagtaacaaactttggtgaaatttcaggaaccatagccattgaagtggatgagggaacctatatacatgcactcaacaatggtctttttaccctgggagctccacacaaagaaggtttgtgtctggaacggaagatcctgccacaagtgtagattttaggacattcattcacttaggccaaactctaactagtctcaaacattttccaaaggaatggaaccattgcatttgactcttccatttttttaaattccttaatatgtaccagccattggcaagtccctctttctaatataagcatttgaaaacattccgtatagttccagaagagtatctttggaaatccaaacaatatgaataattaaaatagtaagtggaaagaaaaaagaaaacctatttgagtcaaacatatttgaatttcttttttattcagacctattaccaaaactaacctgggtgcatttaacagtttgaagtttccacattttctttagcccattagaggaagcactaatgagatacgaagtaattagaagataaaaagcagtatcatttcgtcagcaaggccatccattgaataaatgaaagcatttagcttttttaaataagtgcttatttatgactgtattttaaaacaaagagaagctatctcgaaagttattaaataagcattatatcaccctgtcttactcagtgtatacaattagcactatagttaaaagaaggtaaaatagatcttgattccaaagatacagtattacagtgacatcagtatatctgaatattcttacatttaattgcagaagaaaatagccacattttttaaagcaaaataatgtctttatatttatagcatatgtcaaatttattttcaaatgttttttctccaatagttgatgagggccctagtcctccagagcagtttatggctgtcaaattatctgattccaggtgaacttatattgtaatataattagtaaccagttattttaaaaatttaattgtattcattaaaaattttagtatctgtcttaagcccatggtaattttgatataaaaaacaaaatagcttttttgaaaagtagattttgtgatctacttttagtggatttcctctcaatatataatgctaggctggagaaaagatatgtaagttaaaagatgaagattaataattttatacggcaaataagatagattaaaaaataaatcaaatagtacaaaacctggttcactgttgctatgatatttaaactcactgtttggaagtccaaagacaaacaggaagactaaaaaaaaggaatattgttgaaaccagcagagaatgttacagcatcataacgaccaaaagaatatttgtactcactatttttacagtcattttattttttattctcaccttgtgcagaagtatagaatgattctttgggtaaaagatactgaaagtgaatttacatattttagtaattggttacatcaacatgataatgatttctgttatataatcattaatgtataagggagtaaaagtcaattctggcatccgaggagattcttggtaaggtaaaagaaatcataattttaaaaaatcacattaagatgattatttctatactttctttgaaagtgataagtagggtgaaaaagaataaaagcagaggaagaaaaactcaatagttttaaactgctttacaattataaacaaaaaaggattataaataaaactgacaaatgagaaaatatttgcaacaatcttaataggcagtgagttcttactcttcatatgtatcttgtatagaattcatagcactgaagaccccagtagaaaaattgcgaacaatcagatctgaatagaaaaatggacaaggggcattaccagataatctaaaaactaaaaaggaaaggaaaagaaaaataattgttattctagttaactactaaaatgcaaattaataggatactgtttttttcatatcaggttttcaagtatttttttagagtcataacatttaaaaaaaaaatccatgatacaaaacatactctgttaatttgaggtaagaatgtaaatggaagcagcattttctggaaaacagtttgatgacataaagttttagtaatttattattgaagtttataactaaagaggtataattgaagcatgatgaattttgaaaatatttattatgtaatatataaggtacaatgtttatattaaaaaagcaaaatataaaactaaatttaaaactgtactgtccaatatggcaacaactagtcacatgtagcttttttttttttttgaaggcacagagtctcactctgtcacccaggctggagggcagtggtgtgatcatagctcactataacctcaaatttctgggctcaagcactcctcctgcgtcagcctcccaagtagctggtattacatgtgcacaccaccatgcccagctaactttttaaattttttgtaaagatggggtctcactatgttgtccaggctgatcttgaacttcttgcctcaagcacttctcccattggcttcccaaagcacagagattacaggagtgagtcaccactcagccacatgcatcttttgaacacttggaatatgtccagtctggaattttagatatgtacacacccacacacatacacatgtcctgttttgatgtcctataattaattttctcttagtttttaacttttatctatcttattaatgtacagaatcgccctgaaacctggctatggaaaatatcttagtataaattcagatgaacttgttgttggcgttcagatgcaattggaccaagagaacaatgggaaccagtctttcaaaatgtgagtgctgttattgtttataaaaacttcctgtcagtttaacacaaagtctgtagcagtcaataataatatatttaaaaagaaaaagtaggatgcaatagtacaatacattaaattggaataaatcagtaagaacacagagccttaaagagatctcaaaatatagtgcaacaaaaatagctttagtacttttgcccacaattatttctgtatacccttagtgcccgatatggatctcatttccattgaagaaccagtcaattttaggtcacagagtaggaaaacagaatcgttcctaagtatcttctttgtggcagaaatcatggatgctttcagaaactttagagactgtaagcgaacagtagagctagctaataccaagttgtgacaatttgcttataaaatataaataataatagttcattgaagtaaattatctctaaaagactttcagttcataaacttaaaatagtgtatgaaaagatagttttaatataagaagaaaaaagataatatactaattcttaattttagtaagtagacagttgtagtgtatggatgttttgttaaatctttgttgatacagaatatataatttcctttttctgtttgtgtgagaagtaaagattgaacaaaaatatgtgagtgctaaactgtctttaaaaagtagataactatatcaaaaacagtaaggaccagtgggcaccatgcagaacaagcaaatagaagctcagcctttgagtagcagctttggtagtatacaaaaatgaactgaaaataggaactcagcagtgttttaagatgacagattaaacaaacatcccaccagaaagaggtaatcacttagactaatttcctcatcccctaggataaaatcttaagtcagtgacttgaaaactattttgacccaatccattgagaaatgcatttttacattgcagcccagcacacacatatgtataactgaagcaagagttgtacttaacaatacttacttatccgtgtgttatgcatcttgatatttcttattctcttttaccccttcctctgtgtgtgtgtgtgtattctttttcccccccacccacccgataccgttcaggaaacactacgttgatttcattacctgctaatgtgttgcaacccctttgagatgatcctactagttatgatgagatgcttctaataaaagttacaccagtagaaaatgccaatatttcataaggccaggatgatgacttagatagtactaatattacaacactttaggaaagttcatttcattttatttttaggaaggacactaatagagttccataaaagaaaagtctttagtgcatgttatttattattcagggtgtagatactattttaacttccacattctaaattatagtgtgggtatcaatctatgaagtaggtgctgacaagttgtcaacattactgacttttatggtgaagttttaaatttgaatttttattcaaatataaatgaaaagaccattttctcaggtaaaaaaatctatcatgctttgatgcttttcactttaattgaaaaaagactcattataaaagtacaatgcaagaaatatttagaaaaatattcctgatctccagttgttactgtacctagatttttcttgggacctatgtgataaaacttatcatgattcttgaagaaatagaagttcatacaactgttatcagaatttatataaaatgtttctcagaaaatgtggtttctccagctcgaacattctataactctaagccaaattgaaagagcagattgatgggataaaacacaaagtatggaaataaataataaactgctaccctgaaaaagcctacctctgcacattgtttaaaaattggaaaaaatcctacttctgtgttctgatattcaatgcaagtcattagagtaaggtgagactcttcctgtggattcagattgaaatcagggacggtgtagggaggccatggtcaacttttgagctacccttgagggaagaaattaattgatcaaatattaactgcccaagtatattcacaggatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagcaaaataaagcattaa

SEQ ID NO: 12808 - DNA, 6056 bp, Homo sapiens
atatatatttttttaatttattattattttactttaagttttagggtacatgtgcacaatgtgcaggttagttacatatgtatacatgtgccatgctggtgtgctgcacccactaacttgtcatctagcattacgtatatctcccaatggtatccctccccactcccccaccccacagcagtccccacagtgtgatgttccccttcctgtgtccatgtgttctcattgttcaattcccatctatgagtgagaatatgcggtgtttggttttttgctcttgtgatagttttctgagaatgatgatttccaatttcatccatgtccctacaaaggacatgaactcatccttttttatggctgcatagtattccatggtgtatatgttccacattttcttaatccagtctatcattgttggacatttggattggttccaagtctttgctattgtgaatagtgccgcaataaacatacgtgtgcatgtgtctttatagcagcatgatttatagtcctttgggtatatacccagtaatgggatggctaggtcaaatggtatttcttgttctagatccctgaggaatcgccacactgacttccacaatggttgaactagttgacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtcctttgcccactttttgatggggttgtttgtttttttcttgtaaatttatttgagttcattgtagattctggatgttagccctttgtcagatgagtaggttgtgaaaattttctcccattttgtaggttgcctgttcactctgatggtagtttcttttgctgtgcagaagctctttagtttaattagatcccattagtcaattttggcttttgttgccattgcttttggtgttttagacatgaagtccttgcccatgcctatgtcctgaatggtaatgcctaggttttcttctagggtttttatcgttttaggtctaacatttaagtctttaatccatcttgaattgatttttgtataaggtgtaaggaagggatccagtttcagctttctacatatgcctagccagttttcccagcaccatttattaaatagggaattctttctccattgcttttttttctcaggtttgtcaaagatcagatagttgtagatatgcggcgttatttctgagggctctgttctgtttcattgatctatatctctgttttggtaccagtaccatgctgttttggttactgtagccttgtagtatagtttgaagtcaggtagtgtgatgcctccagctttgttcttttggcttaggattgacttggcgatgcgagctcttttttggttccatatgaacattaaagtagttttttccaattctgtgaagaaagtcattggtagcttgatggggatggcattgaatctgtaaattactttgggcagtatggccattttcacgatattgattcttcctacccatgagcatggaatattcttccatttgtttgtatcctcttttatttccttgagcagtggtttgtagttctccttgaagaggtccttcacatcccttgtaagttggattcctaggtatttcattctctttgaagcaaatattctctttgaatgggagttcactcatgatttggctctctgtttgtctgttgttggtgtataagaatgcttgtgatttttgtacattgattttctatcctgagactttgctgaagttgcttatcggcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcacattcagtatgatattggctgtgggtttgtcatagattgctcttattattttgaaatatgtcccattaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttggtatcaggatgacgctggcctcataaaatgagttagggaggattccttctttttctattgattggaatagtttcagaaggaatggtacaagttcctccttgtacctctggtagaattcggctgtgaatccctctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccattttcattttttattgtgtctatttgattcttctctctttttttctttattagtcttgctagcggtctatcaattttgttgatcctttcaaaaaaccaactcctggattcattaattttttgaagggttttttgtgtctctgtttccttcagttctgctctgattttagttatttgttgccttctgctagcttttgaatgtgtttgctcttgcttttctagttcttttaactgtgatgttagggtgtcaattttagatctttcctgctttctcttgtgggtatttagtgcaataaatttccctctacacactgctttgaatgtgtcccagagattctggtatgttgtgtctttgttctcgttggtttcaaagaacatctttatttctgtcttcatttcgttatgtacccagtggtcattcaggagcaggttgttcagtttccatgtagttgagcggttttgagtgagattcttaatcctgagttctagtttgattgcactgtggtctgagagatagtttgttataatttctgttctcttacatttgctgaggagagctttacttccaactatgtggtcaattttggattaggtgtggtatggtgctgaaaaaaatgtatattctgttgatttggtgtggagagttctgtagatgtctatcaggtccacttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgccttatgaatctgggtgctcctgtattgggtgcatatatatttaggatagttagctcttcttgttgaattgatccctttaccactatttaatggccttctttgtctcttttgatctttgttggtttaaagtctgttttatcagagactaggattgcaacccctgccttttcttgttttccatttgcttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttactcattagttgatgcagtttcttcctagtctcgatggtctttacaatttggcatgattttgcagcagctggtaccggttgttcctttccatgtttagcgcttccttcaggagctcttttaaggcaggcctggtggtgacaaaatctctcagcatttgcttctctgtaaagtattttatttctccttcacttatgaagcttagtttggctggatatgaaattctgggttgaaaattcttttctttaagaatgttgaatattggcccccactctcttctggcttgtagagtttctgccaaaagatctgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggattatatcctgcagagtgctttccaacttggttccattctccctgtcacttgcaggtacaccaatcagatgtagatttggtcttttcacatagtcccatatttcttggaggctttgctcatttctttttattcttttttctctaaacttcccttctcacttcatttcattcgtttcatcttccatcactgataccctttcttccagttgatcgcatcggctcctgaggcttctgccttcttcatgtagttctcgagccttgcttttcagctccatcagctcctttaagcacttctctgtattggttattctagttatacattcttctaaatttttttcaaagttttcaacttctttgcctttggtttgaatgtcctcccatagctcggagtagtttgatcgtctgaagccttcttctctcagctcgtcaaagtcactctccgttcagctttgttccgttgctggtgaggaactgcgttcctttggaggaggagaggcgctctgctttttagagtttccagtttttctgctctgttttttccccatctttgtggttttgtctacttttggtctttgatgatggtgatgtacagatgggtttttggtgtgcatgtcctttctgttcgttagttttccttctaacagacaggacccttagctgcaggtctgttggagtactgggccgtgtgaggtgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaagttactgctgtctttttgtatgtctgtgccctgcccccagaggtggagcctacagaggcaggcaggcctcctggagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggcgtaggaccctccgagccaggtgcaggatgtaatctcctggtgcgcggtttttttaagcccgtcggaaaagcgcagtattcgggtgggagtgacccgattttccaggtgccctctgtcacccctttgactaggaaagggaactccctgaccccttgtgcttcccgagtgaggcaatgcctcgccctgcctcggctcacgcacagtgcgtgcacccactgacctgcacccacccactgacctgcacccactgtctggcagtccctagtgagatgaacccggtacctcagatggaaatgcagaaatcacccatcttctgcgttactcacgctgggagctgtagaccggagctgttcctattcggccatcttggc

SEQ ID NO: 12809 - DNA, 5446 bp, Homo sapiens
ttgttttttgtttttttttttttcatttatttttattttattttattttattttttttattatactctaagttttagggtacatgtgcacattgtgcaggttagttacatatgtatacatgtgccatgctggtgcgctgcacccactaatgtgtcatctagcattaggtatatctcccaatactatccctcccccctcccccaaccccaccacagtccccagagtgtgatattccccttcctgtgtccatgtgatctcattgttcaattcccatctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggatgcgaaaattttctcccatgttgtaggttgcctgttcactctgatggtagtttcttttgctgtgcagaagctctttagtttaattagatctcatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctacataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatacactgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctc

SEQ ID NO: 12810 - DNA, 6075 bp, Homo sapiens
tttccatgtttgctttggtttggttttttttttttttttttcatgtgttttttttttattatactctaagttttagggtacatgtgcacattgtgcaggttagttacatatgtatacatgtgccatgcttgtgcgctgcacccactaatgtgtcatctagcattaggtatatttcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaaccggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcattgtgaatgggagttcacccatgatttggctctctgtttgtctgttgttggtgtgtaagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggttctgcttggtgcagagctgagttcaattcctgggtatccttgttgactttctgtctcgttgatctgtctaatgttgacagtggggtgttaaagtctcccattattaatgtgtgggagtctaagtctctttgtaggtgactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttgtcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccatttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgacccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccag

SEQ ID NO: 12811 - DNA, 5688 bp, Homo sapiens
ctttttttttttattatactttaagttttagggtacatgagcacaatgtgcaggttagttgcatatgtatacatgtgacatgttggtgtgctgcacacattaactcatcatttaacattaggtatatctcctaaagctatccctcccccctcgcgccaagccacaagaggccgcgctgtgcgatgttccccttcctgtgtccatgtgtacttgttgttcgagtcccagctatgagtgagaacatgcggtgtttggtattggtctccttgtgatattttgctgagaatgatggtttccagcttcatccgtgtccgtacaaaggacatgaactcatccttttttatgtctgcatagtattccatggtgtatatgtgccacattttcttaatccagtctatcatcgttggacatttgggttggttccaagtctttgctattgtgaatagtgccacaataaacatatgtgtgcatgtgtcttcatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgcgcattttttcatgtgtcttttggctgcataaatgtcttcttttgagaggtgtctgttcatatcctttgcccactttttgatggggttgtttgtttttttctcgtaaatttgttggagttcattgtagattctggatattagccctttgtcagatgagtagattgcaaaaattttctcccattctgtaggtggcctgttcagtctgatggtagtttcttttgctgtgcagaagctctttagtttaattagatcccatttgtcaattttggcttttgttgccattgcttctggtgttttagacatgaagtcctcgcccatgcctatgtcctgaatggtattgcctgggttttcttctagggtttttatagttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttatcaggtttgtcaaagatcagatggttgtagatatgtggcattatttctgagggctctgttctgttccattgatctatatctctgttttgataccagtaccatgctgttttcgttattgtagccttgtagtatagtttgaagtcaggtagcatgatgcctccagctttgttcttttggctgaggattgacttggcaatgcgggctcttttttggttccatatgaactttaaagtagtttttttccaattctgtgaagaaagtcattggtagcttgttggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaggttggattcctaggtatttcattctctttgaagcaattgtgaatgggagttcactcatgatttggctctctgtttgtctgttgttggtatataagaatgcttgtgatttttgcacattgattttgtatcctgagactttgctgaagttgcttattagcttaaggagattttgggctgagatgatggggttttctagatatacaatcatgtcatcggcaaacaggaacaatttgacttcctcttttcctaattgaatgccctttatttatttctcctgcctgattgccctggccagaacttccaacactatgttgaacaggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagataatcatatggtttttgttgttggttctgtttatatgctggattatgtttattgatttgcgtatgttgaaccagcctcacatcccagggatgaagcccattcgatcatggtggacaaggtttttgatgtgctgctggatttggtttgccagtattttattgaggatttttgcatcgatgttcatcagggatattgctctaaaattctctttttttgtgtgtctctgccaggctttggtatcaggatgatgctgggctcataaaatgagttagggaggattccctctttttctgttgattggaatagtttcagaaggaatggtaccagttcctccttgtacctctggtagaatttggctgtgaatccatctggtcctggacttcttttgtttggtaagctattaattattgcctctatttcagagcctgttattggtctattcagagattcaacttcttcctggtttagtcttgggaggctgtatgtctccaggaatttatctatttcttttagattttccagtttatttgcatagaggtgtttatagtattctctgatggtagtttgtatttctgtgtgattggtggacatgtcccctttatcattttttattgcatgtatttgattcttctctcttttcttctttattagtcttgctagcagtctatcaattttgttgatcttttcaaaaaaccagcctctggattcattgattttttgaagggttttttgtgtctctatttccttcagttctcctctgatcttagatatttcttgccttctgctagcttttgaatgtgtttgctcttgcttctctagttcttttaattgtgatgttagagtgtcaattttagatctttcctgctttctcttgtgggcatttagtgctataaatttccctctacacactgctttcaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttattttaatttctgatcttctatatttgctgaggggtgctttacttccaagtatgtggtcaattttggaataggtgtggtgtggtgctgaaaagaatgtatattctgttgattcggggtggagatttctgtagatgtctattaggtctgcttggtgcagagctgagttcaattcctggatatccttgttaactttctgtctcattgatctgtctaatgttgacagcggggtgttaaagtctcccattattaatgtgtgggagtctaagtctctttgtaggtcactcaggacttgctttatgaatctgggtgctactgtattgggtgcatatatatttaggatagttagctcttcttgttgaattgatccctttaccattatgtaatggccttctttgtctcttttgatctttgttggttaaaagtctgttttatcagagactaggattgcaacccctgcctttttttgttttccatttgcttggtagatcttcctccatctctttattttgagcctatgtgtgtctctgcacgtgagatggatttcctgaatatagcacactgatgggtcttgactctatccaatttgccagtctgtgtcttttaattggagcatttagctcatttacatttaaggttaatattgttatgtgtgaatttggtcctgtcattatgatgttagctgtgttttttttttttttcgttaattggtgcagtttcttcctagtctcgatggtgtttacattttggcatgattttgcagtggctggtaccagttgttcctttccatgtttagcgcttccttcagcaccttttttagggcaggccgggtggtgacgaaatctctcagcatttgcttgtctgtaaagtactttatttctccttcacttatgaagcttagtttggctggatatgaaattctgggttgaaaattcttttctttacgaatgttgaatattggcccccaattcttctggcttgtagagtttctgccgagagatccgctgttagtctgatgggcttccctttgagggtaacccgacctttctctctggctgcccttaacattttttccttcatttcaactttggtgaatctgacaattatgtgtcgtggagttgctcttctcgaggagtatctttgtggtgttctctgtatttcctgaatctgaacgttggcctgccttgctagattggggaagttctcctggataatatcctgcagagtgttttccaacttggttccattctccccgtcactttcaggtacaccaatcagatgtagatttggtcttttcacatagtcccatatttcttggaggctttgttcctttctttttattcttttttctctaaacttcccttctcgcttcatttcattcatttcatcttccatcgctgataccctgtcttccagttgatagcattggctcctgaggcttctgcattcttcacgtagttcttgagtcttggttttcagctccatcagctcctttaagcacttctctatattgattattctagttatacattcttctaaatttttttcaaagttttcaacttctttgcctttggtttgagtgtcctcctgtagctcggagtaatttgatcgtctgaagccttcttctctcagctcgtccaagtcattctccatccagctttgttccattgctggtgaggaactgcgttcctttggaggaggagagacgctctgctttttagagtttccagtttttctgctctgttttttccgcatctttgtggttttatctagttttggtctttgatgatggtgatgtacagatgggtttttggtgtggataccctttctgtttgttagttttccttctaacagacaggaccctcagttgcaggtctgttggagtacctggccgtgtgaggtgtcagtctgcccctgctggggattgcctcccagttaggctgctcggggatcaggggtcagggacccacttgaggaggcagtctgtccattctcagatctccagctgcgtactgggagaaccactgctctcttcaaagctgtcagacagggacatttaagtctgcagaggttactgctgtgtttttgtttgtctgtgccctgcccccagaggtggaacctacagaggcaggcaggcctccttgagctgtggtgggctccacccaatttgagcttccaagctgctttgtttacctaagcaagcctgggcaatggcagacacccctctcccagcctcactgccaccttgcagtttgatctcagactgctgtgctagcaatcagtgagactctgtgggcataggaccctccaagcca

SEQ ID NO: 12812 - DNA, 6054 bp, Homo sapiens
ttttctttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatctccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattacgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcctgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaaggtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccagtcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgaggtgtcagtgtgcccctgctggggggtgcctcccagttaggctgctcgggggtcaggagtcagggacccacttgaggaggcagtctgtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgaccgtcacccctttctttgactcagaaagggaactccctgaccccttgcgcttcccaggtgaggcaatgctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccccat

SEQ ID NO: 12813 - DNA, 4857 bp, Homo sapiens
  misc_feature (4682)..(4682): n equals a,t,g, or c
atactttaagttctagggtatatgtgcacaacgtgcaggtttgttatatatgtgtacgtgtgccatgttggtttgctgcacccatcaactcatcatttacattaggtatttctcctaacgctatccctcccccagcctcctaccccacaacaggccccggtgtgtgatgttcccctccctgtgtccatgtgttctcattggtcaactcccacttaagagtgagaacatgcggagtttggttttctgtccttgtgatattttgctgagaatcacaatttctagcttcatgcatgtccctgcaaaagacaagaactcatccttttttatggctgcatagtattctttggtgtatatgtgccacattttctttatctagtctattattgatggacatttgggttagttccaagtctttgctattgtgaatagtgcctcaataaacataggtgtgcacatgtctttatagtagcatgatttataatcctttgggtattcacccggtaatgagattgctgggtcaaatggtatttctagttctagatccttgaggaattgccacactgtcttccacaatggttgaactaatttatactcccaccaagagtgtaaaagcgttcctatttctccacatcctctacagcatctgttgtttcctgactttttaatgatcgtcattctaactggcatgagtggtatctcattgtggttttgatttgcatttctctgatgaccagtgatgatgagcattttttcatatgtctgttggctgcataaatgtcttcttttgagaagtgtctgttcatatcctttgccctctttttgatggggttgtttttttttcctgtaaatttgtttgagttctttgtagattctggatattagccctttgtcagatgagtagattgcaaaaattttctcccattctgtaggttgcctgttcactctgatggtagtttgttttgctgtgcagaagctttttagtttaattagatcccatttgtcaattttggcttttgttgccattgcttttggtgttttagacatgaagtccttgcccatgcctatgtcctgaatggtattgcctaggttttcttctagggtttttatggttttacatctaacatttaagtctttaatccaccttgaattaatttttgtataagatgtaaggaagggatccagtttcagctttctgcatatggctagccagttttcccagcaccatttgttaaatagggaatcctttccccatttcttgtttttgtcaggtttgtcaaagatcagatagttgtagatgtgtggtgttatttctaagggctctgttctgttccattggtctgtatctccgttttggtaccagcaccatgctgttttgtttactgtagccttgtagtatagtttaaagtcaggtagtgtgatgcctccagctttgttcttttggcttaggattgacttggcaatgcgggctcttttttggttacatatgaactttaaagtagttttttctaattctgtgaagaaagtcattggtagcttgatggggatggcattgaatctataaattaccttgggcagtatggccattttcacgatattgtttattcctctccatgagcatggaatgttcttccatttgtttgtgtcctcttttatttccatgaacagtggtttgtagtcctccttgaagaggtccttcacatcccttgtaagttggattcccaggtattttattctgtttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgaggtgatggggggttctagataaacaatcatgtcatctgcaaacagggacagtttgacttcctcttttcctaattgaggaaaagactctctatttctttctcctgcctgattgccctggccagaacttccaacactatgttgaataggagtggtgggagagggcatccctgtcttgtgccagttttcaaagggaatgcttccagtttttgcccattcagtatgatattggctgtgggtttgtcataaatagctctcattatttttagatacgtcccatcaatacctaatttattgagagtttttagcatgaagtgctgttgaattttgtcgaaggccttttcggcctccattgaaatactcgtggtttttgtcattggttctgtttatatgctggatcacgtttattgatttgtgtatgttgaaccagccttgcatcccagggatgaagcccacttgatcatggtggataagctttttgatgtgttgctggattcggtttgccagtattttattgaggatttttgcatcaatgttcatcagggatattggcctaaaattctccttttttgttttgtctctgccaggctttggtatcaggatgatgctggcctcataaaatgagttagggaggattctctctttttctattgattggaatagtttcagaaggaatgatatcagctcctccttgtacctctgatagaattcggctgtgaatccatctggtcctggactttttttggttggtaagctattaattattgcccgaatttcagagcctgttattggtctattcagagattcagcttcttcctggtttagtcttgcgagggtgtatgtgtcaaggaatttatccatttcttctagattttcttgtttatttgcagagaggtgtttatagtattctctgaaggtagtttgtatttctgtgggatcagtggtgttatcccctttatcattttttattgtgtctatgtgattctgctctcttttcttctttattagtcttgctggcagtctataaattttgttgatcttttcaaaaaaccagctcctggattcattgattttttgaagggatttttgtgtctctatatccttcagctctgctctgatcttagttatttcttgctttctgctagcttttgaatgtgttttctcttgcttctctacttcttttaatggtgatgttagggtgtcgattttagatctttcgtgctttctcttgtgggcatttattgctataaatttccctctacacactactttaaatgtgtcccagagattctgatttgttgtgtctttgttcccgtggattccaaagaacctctttatttctgccttcatttcattatttacccagtagtcattcaggagcaggttgttcagtttccatgtagttgagtggttttgagtgagtttcttaatcctgagttctagtttgattgcactgtagtctgacagacagtttgttataatttctgttcttttacattttctgaggagtgcttttcttccaactatgtggtcaattttggaacaggtgcagtgcggtgctgagaagaatgtatattctgttgacttggggtggagagttctgtagatgtctattaggtccacttggtacagagctgaattcaattcctggatatccttgttaactttctgtcttgttgatctgtctaatgttgacagtggggtgttaaaggctcccattattattgtgtgggagtctaagcctctttgtaggtctctaaggacttgcattatgaatctgggtgctcctgtattgggtgcatatatatttaggatagttagctcttcttgttgaattgatccctttaccattatatagtggccttctttgtctcttttgatctttgttggtttaaagtctgttttttcagagactaggattgcaacccctgcctttttttgttttccatttgcttggtagatcttcctccatccctttattttgggcctgtgtgtgtctctgcatgtgagatggttttcctgaatgcagcacactgatgggtcttgactctttatccaatatgccagtctgtgtcttttaattggagcatttagcccatttacatttaaggttaatattgttatgtgtgaatttgatcctgtcattatgatgttagctggttattttgttcattagttgatgcagtttcttcctagcatcgatggtctttacaatttggcatgtttttgcagtggctggtactagtttttcctttccatatttagtgcttccttcaggagctcttttagggcaggcctggtggtgacaaaatctctcagcatttgcttgtctgtaaagtattttatttctccttcacttatgaagcttcatttggctggatatgaaattctgggttgaaaattcttttctttaagaatgtcgaatattagcccccactccctcctggcttgtagagtttctgccaagagatcacttgttagtctgatgggcttccctttgtgggtatcccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctaggtgtggggaagttctcctggataatatcctgcagagtgttttccaacttggttccattctccctgtcactttcaggtacaccaattagacatagatttggtcttttcacatagtcccatatttcttggaggctttgntcatttctttttattcttttttctctaaacttctcttctcacttcatttcattcatttgatcttgaatcaccaataccctttcttccgttgatcgaatcggccactgaagcttgtgcatttatcatgtagctctcatgccatggttttcagctccacctggtcctttaaggactt

SEQ ID NO: 12814 - DNA, 4911 bp, Homo sapiens; identical to SEQ ID NO: 12769

SEQ ID NO: 12815 - DNA, 6085 bp, Homo sapiens
ttctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaat

SEQ ID NO: 12816 - DNA, 6073 bp, Homo sapiens
tttatctttttttatgttgtttgtgcttttttttttcttttttttcttattatactttaagttttagggtacatgtgcacattgtgcaggttagttacatatgtatacatgtgccatgctggtgcgctgcacccactaactcgtcatctagccttaggtatatctcccaatgctatccctccccgctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccactatggttgaactagtttacagtcccaccaacagtgtaaaagtgttcctatttctccacatcctctccagcacctgttgtttcctgactttttaatgattgccattctaactggtgtgagatgatatctcacagtggttttgatttgcatttctctgatggccagtgatgatgagcatttcttcatgtgttttttggctgcataaatgtcttcttctgagaagtgtctgttcatgtcccttgcccactttttgatggggttgtttgtttttttcttgtaaatttgtttgagttcattgtagagtccggatattagccctttgtcagatgagtaagttgtgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttagggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggccatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgtgatcagtggtgatatcccctttatcattttttattgtgtctatttgattcttctctctttttttctttattagtcttgctagcggtctatagattttgttgatcctttcaaaaaactagctcctggattcattgattttttgaagggttttttgtgtctctatttccttcagttctgctctgattttagttatatcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgattaggggtggagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggctgaaaattcttttctttaagaatgttgaatattggcccccactctcttctggcttgtagggtttctgccgagagatccgctgttagtctgatgggcttccctttgtgggtaacccgacctttctctctggctgcccttaacattttttccttcatttcaactttggtgaatctgacaattatatgtcttggagttgctcttctcgaggagtatctttgtggcgttctctgtatttcctgaatctgaacgttggcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccatcgctgataccctttcttccagttgatcgcatcggctcctgaggcttctgcattcttcacgtagttctcgagccttggtttcagctccatcagctcctttaagcacttctctgtgttggttattctagttatacattcttctaaatttttttcaaagttttcaacttctttgcctttggtttgactgtcctcccatagctcagagtaatttgatcgtctgaagccttcttctctcagctcgtcaaagtcattctccatccagctttgttccgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccctgtgaggtgtcagtgtgccctgctggggggtgcctcccagttaggctgctcgggggtcaggggtcagggacccacttgagggagcagtctgcccgttctcagatctccagctgcgtgctggagaaccactgctctcttcaaagctgtcagacagggacatttaagtctgcagaggttactgctgtctttttgtttgtctgtgccctgcccccagaggtggagcctacagaggcaggcaggcctccttgagctgtggtggctccacccagttccagcttccgggctgctttgtttacctaagcaagcctgggcaatggcgggcgcccctcccccagcctcgctgccgccttgcagttcgatctcagactgctgtgctagcaatcagcgagattccgtgggcgtaggaccctccgagccaggtgtgggatatagtctcgtggtgtgccgttttttaagccggtctgaaaagcgcaatattcgggtgggagtgacccgattttccaggtgcgtccgtcacccctttctttgactgggaaagggaactccctgaccccttgcgcttcccaggtgaggtaatgcctcgccctgcttcggctcgcgcccggtgcgcgcacccactggcctgcgcccactgtctggcactccctagtgagatgaacccggtacctcagatggaaatgcagaaatcacctgtcttctgcattgctcacgctgggagctgtagactggagctgttcctattcggccatcttggctcctcctcccgttgtttgt

SEQ ID NO: 12817 - DNA, 6042 bp, Homo sapiens
gaatcaaaacttttttttttttattatactttaagttttagggtacatgtgcatattgtgcaggttagttacatatgtatacatgtgccatgctggtgcgctgcacccactaactcatcatctagcattaggtatatctcccaatgctatccctccccgctcccgccaccccaccacagtccccagagtgtgatattccccttcatgtgtccatgtgatctcattgttcaattcccacctatgagtgagaatatgcggtgtttgattttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacacacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaacagtgttcctatttctccacatcctctccagcacctgttgtttcctgactttttaatgattgccattctaactggtgtgagatgatatctcatagtggttttgatttgcatttctctgatggccagtgatgaagagcattttttcatgtgttttttggctgcataaatgtcttcttttgagaagtgtctgttcatgtccttcgcccactttttgatggggttgtttgtttttttcttgtaaatttgtttgagttaattgtagattctggatattagcgctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggattttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttgtgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctgtttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaattcctaatttattgagagtttttagcatgaagggttgttgaattttgtcaaaggctctttctgcatctattgagataatcatgtggtttttgtctttggctctgtttatatgctggattacatttattgatttgcatatattgaaccagccttgcatcccagggatgaagcccacttgatcatggtggataagcttcttgatgtgctgctggattcggtttgccagtattttattgaggatttttgcatcaatgttcatcaaggatattggtctaaaattctctttgttcattgtgtcgttgtccagctttggtatcaggatgatgctggcctcataaaatgagttagggaggattccctctttttctattcattggaatagtttcagaaggaatggtaccagttcctccttgtacctctggtagaatttggctgtgaatccatctggtcctggactctttttggttggtaaactattgattattgccccaatttcagctcctgttattggtctattcagagattcaacttcttcctggtttagtcttgggagagtgtatgtgttgaggaatgtatccatttcttctagattttctagtttatttgagtagaggtgtttgtagtattctatgatggtagtttgtatttctgtgggatcagtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgatataatttctgttcttttacatttgctgaggagagctttacttccaagtatgtggtcaattttggaataggtgtggtgtggtgctgaaaaaaatgtatattctgttgatttggggtggagaattctgtagatgtctattaggtccgcttggtacagagctgagttcaattcctgggtattcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggggcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgtagagtgttttccaacttggttccattcttcccatcactttcaggtacaccaatcagatgtagatttggtcttttcacatagtcccatatttcttggaggctttgctcatttctttttattcttttttctctaaccttcccttctcgcttaatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgcgttcctttggaggaggagaggtgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcaggtctgttggaataccctgccgtgtgaggtatcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtcttttcgtttgtctgtgccctgcccccagaggtggagcccacagaggcaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcccttcccaggtgaggcaatgcctcgccctgcttcggctcgcgcccagtgcgtgcacccactggcctgcgcccactgtctggcactccctagtgagatgaacccggtacctcagatggaaatgcagaaatcacccgtcttctgcgtcgctcacgctgggagctgtagaccagagctgttcctattcggccatcttggctcctcctcct

SEQ ID NO: 12818 - DNA, 6268 bp, Homo sapiens
attttcttttttaaaaaattttattattattttactttaagttttagggtacatgtgcacaatgtgcaggtttgttacatatgtatacatgtgccatgttggtgtgctgcacccattaactcgtcatttagcattaggtatatctcctaatgctatccctcccctcttcccccaccccacaacagtccccagagtgtgatgttccccttcctgtgtccatgtgttctcattgttcaattcccatgtatgagtgagaacatgtggtgtttggttttttgtccttgcgacagtttgctgagaatgatggtttccagcttcatccatgtccctacaaaggacatgaactcatcatttttttatggctgcatagtattccatggtgtatatgtgccacattttcttaatccagtctatcattgttggacatttgggttggttccaagtctttgctattgtgaatagtgccacaataaacatatgtatgcatgtgtctttatagcagcatgatttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttttttttattattatactttaagttttagggtacatgcgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccgtggtgtatatgtgccacattttcttaatccagtctatcattggtggacatttgggttggttccaagtctttgctattgtgaataatgctgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacagtaccaccaacagtgtaaaagtgttcctatttctccacatcctctccagcacctgttgttccctgactttttaatgattgccattctaactggtgtgagatggtatctcattgtgttttgatttgcatttctctgatggccagtgatgatgagcattttttcacgtgttttttgtctgcataaatgtcttcttttgagaagtgtctgtttatatcctttgcccactttttgatggggttgtttttttcttgtaaatttgtttgagttcattgtagattctggatattagccctttgtcagatgagtaggttgcaaaatttttctcccattctgtatgttgcctattcactctgatggtggtttcttttgctgtgcagaagctctttagtttaattagatcccatttgtcaattttgtcttttgttgccattgcttttggtgttctagacatgaagtccttgcccatgcctatgtcctgaatggtattgcctaggttttgttctagggtttttatggtgttaggtctaacatgtaagtctttaatccatcttgaattaatttttgtataaggtgtaaggaagggatccagtttcagctttctacatatggcgagccagttttcccagcaccatttattaaacatggaatgctttccccattgcttgtttttgtaaggtttgtcaaagatcagatagttgtagatatgcggcattgtttctgagggctctgttccgttccattggtctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaaccttaaagtgtttttttccaattctgtgaagaaagtcattggtagtttgatggggatggcactgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtatttgattctctttgaaacaattgtgaatgggagttcactcatgatttggctctctgtttgtctgttattggtgtataagaatgcttgtgatttttgtacattgattttgtatcctgagacgttgctgaagttgcttatcagcttaaggagattttgggctgagacaatggggttttccagatatacaatcatgtcatctgcaaacagggacaatttgacttcctcttttcctaattgaatgccctttatttccttctcctgcctaaatgccctggccagaacttccaacactatgttgaataggagtggtgagagagggcatccctgtcttgtgcccgttttcaaagggaatgcttccagtttttgtccattcagtatgatattggctgtgggtttgtcatagatagctcttattattttgagatatgtcccatcaatacctaatttattgagagtttttagcatgaaggattgttggattttgtccaaggccttttctgcaactatggagataaccatgtggtttttgtctttggttctgtttatatgctggattacgtgtattgattttcgtatggtgaaccagccttgcatcccagggatgaagcccacttgatcatggtggataggctttttgatgtgttgctggattcggtttgccagtattttattgaggatttgtgtatcaatgttcatcaaagatattggtctaaaattctctttttttgctgtgtctctaccaggctttggtatcaggattatgctggcctcataaaatgagttagggaggattctctctttttctattgattggaatagtttcagaaggaatggtactagctcctccttgtacctctggtagaattcagctgtgaatccatctggtcctggacttttttgttgttggtaggctattaattattgcctcaatttcagatcctgttattggtctattcagagattcaatttcttcctggtttagtcttgggagggtgtatgtgtcaaggaatttatccatttcttctagattttctagtgtatttgtgtagaggtgtttatagtattctctgatggtagtttgtatttctgtgggatcggtggtgatatcccctttatcatgttttattgcatgtatttgattcttctctcttttcttctttattagtcttgctagcggtctatcagttttgttgatcttttcaaaaaaccagctcctggattcactgattttttttgaagggttttttgtgtctctatttccttcagttctgctctgatcttagttatttcttgccgtctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcatttcgttatgtacccagcagtcattcaggagcaggttgttcagtttccatgtagttgagtggttttgagtgagtttcttaatcctgagttctagtttgattgcactgtggtctgagagatagcttgttataatttcttttattttacatttgctgaggagtgctttacttccaactatgtggtcaattttggaataggtatggtgtggtgctgaaaagtatgtatattctgttgatttggggtggagagttctgtagatgtctattaggtctgcttggtgcagagctgagttcaattcctggatatccttgttaactctctgtctcgttgatctgtctaatgttgacagtggggtgttaaagtctccctttattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatcttttttggtttaaagtctgtcttatcagagactaggattgcaacccctgcctttttttgttttccatttgcttggtagatcttcctccatccctttattttgagcctatgtgtgtctctctgcacatgagatgggtttcctgaatacagcacactgatgggtcttgactctttatccaatttgctagtctgtgtcttttaattggagcatttagcccatttacatttaatgttaatattgttacgtgtgaatttgatcctgtcattatgatgttagctggttattttgctcgttagttgatgcagtttcttcctagccttgatggtctttacaatttggcatgtttttgcagtggctgataccggttgttcctttccatgtttagtgcttccttcatgagctcttttagggcaggcctcgtggtgacaaaatctctcagcatttgcttgtctgtaaagtatcttatttctccttcacttatgaagtttagtttggctggatatgaaattctcggttgaaaattcttttctttaagaatgttgaatattggcccccactctcttctggcttgtagagtttctgccaagagatccactcttagtctgatgggcttccctttgtgggtaacccgacctttctccctggctgcccttaacattttttccttcatttccactttggtgaatctgacaattatgtgtcttggagttgctcttctccagaagtatctctgtggtgttctctttatttcctgaatttgaatgttggcctgccttgctagattggggaaattctcctggataatatcctgcagaatgttttctaacttggttccattctccccgtcactttcaggtacaccaatcagacgtagatttggtcttttcacacagtcccatattttttggaggctttgttcatttatttttattcttttttctctaaacttatcttctcacttcatttcattcattttatcttccattgctgataccctttcttccagttgattgcatcggctactgaggcttgtgcattcgtcacgtagttctcatgccatggctttcagctccatcaggtcctttaaggacttctcttcattggttattctagttagccattagtctaattttttttcaagatttttaacttctttgccattggttcgaacttcctcctttagcttggagtagtttgatcttctgaagccttcttctctcaacttgtcaaagtcattctccatccagctttgttccattgctggtgaggagctgtgttcctttggagaaggagaggcactctgatttttagagtttctggtttttctgttctgttttttccccatctttgtggttttatctacctttggtctttgatgatggtgatgtacagatgggtttttggtgtggatgtcctttctgtttgttcgttttccttctaacagtcaggaccctcagctgcaggtctgttggagtttgctggaggtccactccaacaaactcctgggtatcagcagcagtggctgcagaacagcagatattggtgaaccgcaaatgctgctgcctgattgttcctctggaagttttgtctcagaggagtacccggctgtgtgaggtgtcagtccacccctactggggggtgcctcccagttaggctactcggggttcagggacccacttgaggaggcagtccgcctgttctcagatctcaagctgcatgctgggagaaacactactctcttcaaagctgtcagacagggatatttaagtctgcagaggttactgctgccttttgt

SEQ ID NO: 12819 - DNA, 6038 bp, Homo sapiens
tttttttttaaattttattattatactttaagttttagggtacatgtgcacaatgtgcaggttagttacatatgtatacatgtgccatgctggtgtgctgcacccattaactcgtcatttagcattaggtatgtctcctaaagctatccctccccactctccccaccctacaacagaccccagagtgtgatgttccccttcctgtgtccatgtgttcccattgttcaattcccacctatgagtgagaatatgcagcgtttggtttcttgttcttgcgatagttcactgagaatgatgatttccaattcatccatgtccctataaaggacatgaactcatcattttttatggctgcataatattccatggtgtatatgtgccacattttcttaatccagtctatcattgttggacatttgggttggttccaagtctttgctattgtgaatagtgccgcaataaacatacgtgtgcatgtgtctttagagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgagtttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattacttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagatgtccttcacatcccttgtaagttggattcctaggtattttattctctttgaagcaattgtgaatgggagttcactcatgatttggctctctgtttgtctgttgttggtgtgtaagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggttggccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagagtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctattctccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatggagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatactctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcttcttgttgaattgatccctttaccattatgtaatggccttctttgtctcttttgatcttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttgcctaagcaagcctgggcaatggcgggcgcccctcccccagcctcgttgccgccttgccgtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccg

SEQ ID NO: 12820 - DNA, 6050 bp, Homo sapiens
ttttttttaagtatgacttttctttttttttattatactttaagtttgagggtacatgtgcacaatgtgcaggttagttacatatgtatacatgtgccatgctggtgcgctgcacccattaactcgtcatctagcattaggtgtatctcccagtgctatccctccccactacccccaccccacaacagtccccagagtgtgatgttccccttcctgtgtccatgtgttctcattgttcaactcccacctatgagtgagaatatgcggtgtttggttttttgttcttgcaagagtttactgagaatgatgatttccaatttcatccatgtccctatgaaggacatgaactcatcattttttatggctgcataatattccatggtgtatatgtgccacattttcttaatccagtctatcattgttggacatttcggttggttccaagtctttgctattgtgaataatgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatgactgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttctttcttgtaaatttgtttgaattcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaaagcctaggttttcttctagggtgtttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtcgttttttccaattctgtgaagaaagtcattggtagcttgatggggatggcattgaatctgtaaattaccttgggcagtatgaccattttcacgatattgattcttcctacccatgagcatggaatggtcttccatttgtttgtatcctctttcatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtttaagaatgcttgtgatttttgtacattgattttgtatcctgagagtttgctgaagttgcttatcagcttaaggagattttgggctgagacaatggggttttctagatatacaatcatgtcatctgcaaacagggacaatttgacttcctcttttcctaattgaataccctttatttccttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgaaatatgtcccatcaatacctaatttattgagagtttttagcatgaagggttgttgaattttgtcaaaggccttttctgcatctattgagataatcatgtggtttttgtctttggttctgtttatatgctggtttacatttattgatttgtgtatattgaaccagccttgcatcccagagatgaagcccacttgattatggtggataagctttttgacgtgctgctggattcggtttgccagcattttattgaggatttttgcatcaatgtttatcaaggatattggtctaaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatccgttattggtctattcagagattcaacttcttcctggtttagtcttgggagagtgtatgtgtcgaggaatttatccatttcttctagattttctagtttatttgcgtagaggtgtttttagtattctctgatggtagtttgtatttctgtgggatcagtggtgatatcccctttatcattttttattgcgtctatttgattcttctctctttttttctttatttagtcttgctagcggtttatcaattttgttgatcctttcaaaaaactagctcctggattcattaatttttttgaagggttttttgtgtctctatttccttcagttctgctctgattttagttatttcttgcctcctgctagcttttgaatgtgcttgctcttgcttttctagttcttttaattgtgatgttagggtgtcaattttggatctttcctgctttctcttgtgggcatttagcgctataaatttccctctacacactgctttgaatgtgtcccagagattctggtatgttgtgtctttgttctcgttggtatcaaagaacctctttatttctgccttcatttcgttatgtacccagtagtcatccaggagcaggttgttcagtttccatgtagttgagcagttttgagttagattcttaatgctgagttctagtttgattgcactgtggtctgagagatagttttttataatttctgttcttttacatttgctgaggagagctttacttccaagtatgtggtcaattttgtaataggtgtggtgtggtgctgaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgcttatgaatctgggtgctcctgtattgggtgcatatacatttaggatagttagctcttcttgttgaattgatccctttaccattatgtaatggccttctttgtctcttctgatctttgttggtttaaagtctgttttatcagagactaggattgcaacccctgctttttttgttttccatttgcttggtagaccttcctccatccatttattttgagcctatgtgtgtgtctgcacatgagatgggtttcctgaatacagcacactgatgggtcttgactctttatccaatttgccagtctgtgtcttttaattggagcatttagtccatttacattgaaagttaatcgtgttatgtgtgaatttgatcctgtcattatgatgttagctggttattttgttcgttagttgatgcagtttcttcctagtcttgatggtctttacattttgacatgattttgcagcggctggtaccagttgttcctttccatgtttagcgcttccttcaggagctcttttagggcaggcctggtggtgacaaaatctctcagcatttgcttgtctgtaaagtattttatttctccttcacttatgaagcttagtttgactggatatgaaattctgggttgaaaattcttttctttaagaatgttcaatattggcccccactctcttctggcctgtagagtttctgccgagagatccactgttagtctgatgggcttccctttgagggcaacctgacctttctctctggctgcccttaacattttttcctttatttcaactttggtgaatctgacaattatgtgtcttggagttgctcttcttgaggagtatctttgtggcattctctgtatttcctgaatctgaatgttggcctgccttgctagattggggaagttctcctggataatatcctacagagtgttttccaacttggttccattctccccgtcactttcaggtacaccaatcagacgtagatttggtcttttcacatagtcccatatttcttggaggctttgctcatttctttttattcctttttctctaaacttcccttctcgcttcatttcattcattttatcttccattgctgataccctttcttccagttgatcgcatcggctcctgaggcttctgcattcttcacgtagttctcgagccttgtttttcagctccatcagctactttaagcacttctctgtattggttattctagttatacattcttctaaatttttttcaaagttttcaacttctttgcctttggtttgaatgttctcccatagctcagagtaatttgatcgtcagaagccttcttctctcagctcgtcaaagtcattctccatccagctttgttccgttgctggtgaggaactgcgttcctttggaggaggagaggtgctctgctttttagagtttccagtttttctgttctgttttttccccatctttgtggttttatctccttttggtctttgatgatggtgatgtacagatgggtttttggtgtggatgtcctttctgtttgttagttttccttctaacagacaggaccctcagctgcaggtctgttggagtacccagccgtgtgagatgtcagtctgcccctgctggggggtgcctcccagttaggctgcttgggggtcaggggtcagggacccacttgaggaggcagtctgcccattctcagatctccagctgtgtgctaggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcgtcgctgccaccttgcagtctgatctcagaccgctgggctagcaatcagcgagactccgtgggcgtaggaccctctgagccaggtgcaggatataatctcctggtgcgccgttttttaagcccgtcggaaaagcacagtattcgggtgggagtgacccgattttccaggtgccgtctgtcacccctttctttgactaggaaagggaactccctgaccccttgtgcttcccgagtgaggcaatgcctcgctctgctttggctcatgcatggtgcgcgcacccactgacctgcgcccactgtctggcactccctagtgagatgaacccggtacctcagatggaaatgcagaaatcactcgtcttctgcgtcgctcaggctgggagctgtagaccagagctgttcctattcggccatcttggctcctcctcctagaa

SEQ ID NO: 12821 - DNA, 7172 bp, Homo sapiens
cttttcttttttttttaattatactttaagttttaaggtacatgtgcacaacgtcaggtttgttacatatgtatacatgtgccatgttggtgtgctgcacccattaactcgtcatttaacattaggcatatctcctaatgctattccctcccccgtccccctattccacaacaggccctggtgtgtgatgttccccttcctgtgtccatgtgttctcattgtttaattcccacctatgagtgagaacatgcggtgttttgttttttgtcctggcgatagtttgctgagactggtttccagcttcatccatgtccctacaaaggacatgaactcatcattttttacggctgcacagtattccatggtgtatatgtgccacattttctttttttttttttttaattatactttaagttttagggtacatgtgcacattgcgcaggttagttacatatgtatacatgtgccatgctggtgtgctgcacccactaactcgtcatctagcattaggtatatctcccaatgctacccctcccccctccccccaccccaccacagtccacagagtgtgatattccccttcctgtgaccatgtgatctcattgttcaattcccacctatgagtgagaatatgcggtgtttggttttttgttcttgcgatagtttactgagaatgatggtttccaatttcatccatgtccctagaaaggacatgaactcatccttttttatggctgcatagtattccatggtgtatatgtgccacattttcttcatccagtctatcattgttggacatttgggtcggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgtactagtttacagtcccaccaacagtgtaaaagtgttcctatttctccacatcctctccagcacctgctgtttcctgactttttaatgattgccattctaactggtgtgagatggtatctcatagtgttttgatttgcatttctctgatggccagtgatgatgagcattttttcatgtattttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccaggttgtaggttgcctgttcactctgatggtagtctcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtaggcttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttctcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactatagattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattctcctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtgtttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgctataatttctgttcttttacatttgctgaggagagctttacttccaactatgtggtcaattttggaataggtgtggtgtggtgctgaaaaaaacgtatattctgttgatttggggtggagagttctgtagatgtctattaggtccacttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttcagcctatgtgtgtctctgcacatgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttactttggctggatatgaaattctgggttgaaaattcttttctttaagaatgttgaatattggcccccactctcttctggcttgtagggtttctaccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccctcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggtagtctgcccgttctcagatctccagctgcgtgctgggagaaccactgctctcttcaaagctgtcagacagggacatttaagtctgcagaggttcctgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggctcccctcccccagcctcgctgccgccttgcagtttgatctcagactgctgtgctagcaatcagcgagattccgtgggcgtagcaccctccaagccaggtgtgggatatagtctcgtggtgcgccgttttttaagctggtctgaaaagcgcagtattcgggtgggagtgacccgattttccaggtgcgtccgtcacccctttctttgactcggaaagggaactccctgaccccttgcgcttcccaggtgaggcaatcgctcgccctgcttcggctcgcgcacggtgcgcacacccacatggcctgcgcccactgtctggcactccctagtgagatgaacccggtacctcagatggaaatgcagaaatcacctgtcttctgcgtcgctcacgctgggagctgtagaccggagctgttcctattcggccatcttggctcctcccactatgtgccacattttcttaatccagtctatcattgttggacatttggcttggttccaagtctttgctactgttaatagtgtcgcaatgccctctctcaccactcctattcaacatagcgttggaagttctggccagggcaatcaggcaggagaaggaaataaagggtgttcaattaggaaaagaggaagtcaaatagtctctgtttgcagataacatgattgtatatttagaaaaccccatcgtctcagcccaaaatcttaagctgataggcaacttcagcaaagtctcaggatacaaaatcaatgtgcaaaagacacaagcattcttatacaccaataacacacaaacagagagccaaatcatgagtgaactgccattcacaattgcttcaaagacaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagatccaatgccatccccatcaagctaccaatgactttcttcacagaattggaaaaaactactttaaagttcatatggaaccaaaaaggagcccgcatcgccaagtcaatcctaagccaaaagaaaaaagctggaggcatcacgctacctgatttttccccttttcttgcttctcttctc

SEQ ID NO: 12822 - DNA, 5002 bp, Homo sapiens
tattttattagttttttatttttattttttaattatactttaagttctagggtacatgtgcacaatgtgcaggtttgttcatatgtatacacgtgccatgtcggtgtgctgcacccattaactcgtcatttacattaggtatatctcccaatactttccctccccacttccccaacctcacaacaggccccggtgtgtgatgttccccttcctgtgtacaagtgttctcattgttcaattcccacctaggagtgagaacatgcggtgtttgtttttttgttcttgtgatagattgctgagaatgatggtttccagtttcatccatgtccctacaaaggacatgagctcatccttttttatggctgcatagtattccaggatgtatatgtgccacattttctttgttttttttttttttttttttgagacagagtctcgctctgtcgcacattttcttaatccagtctatcattgatggatatttgggttggttccaagtttttcctattgtgaaaaatgctgcaataaacatatgtgtgcatgtgtgtctttatagcagcatgttttataatcctttggatatatacccagtagtgggatggctgggtcaaatggtatttctagttctagatccttgaggaatcgccacactgtcttccacaatggttgaaccagtttacagtcccaccaacagtgtaaaagtattcctatttctccacatcctctccagcacctgttgtttcctgactttttaatgatcaccattctaactggtgtgagatggtatctcgttgtggttttaatttgcatttctctgatggccagtgatgatgagcattttttcatgtgtctgttggctgcataaatgtcttcttttgagaagtgtctgttcatatcctttgcccactttctgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcagaatctccatagtttaattagatcccatttgtcaattttggcttttgttgccattgcttttggtgttttagacatgaagtccttgtccatgcctatgtccggaatggtattgcctaggttttcttctagggtctttatggttttaggtctaacgtttaagtctttaatccatcttgaattaatttttgtataaggtgtcaggaagggatccagttgcagctttctacatatgtctagccagttttcccagcatcatttattaaatagggaaacttttccccatttcttgttcttgccaggtttgtcaaagatcagatggttgtagatgtggggtattatttctgagggctctgttctgttccatttgtctatatctctgttttggtaccagcaccatgctgttttggttactgtagccttgtagtatagtttgaagtcaggtagcatgatgtctccagctttgttcttttggcttaggattgtcttggcagtgtgggctcttttttggttccatatgaactttaaagtagttttttccaattctgtgaagaaactcattggtagcttgatggggatggcactgaatctataaattaccttgggcagtatgtccattttcacgatattgattcttcctacccatgagcatggaatgctcttccatttgtttgtatctttttttattttgttgagcagtggtttgtagttctccttgaagaggtccttcacatcccttgtgagttggattcctaggtattttattctctttgaagccagtgtgaatgagagttcactcatgatttggctctctgtctgttattgctgtataagaatgcttgtgatttttgcacattgattttgtatcttgagactttgctgaagttgcttatcagcttaaggagactttgggctgagacgatggggttgtctaaatatacaatcatgtcatctgcaaacagggacaatttgacttccttttttcttaattgaataccctttatttctttctcctgtctgattgccctggccagaacttccaacactatgttgaataggagtggtgagagaggtcatccctgtctcgtgccagttttcaaagggaatgcttccagtttttgcccattcagtatgaataggcaaacccaataggctgtgggtttgtcataaatagctcttattattttgagatatgtcccatcaatacctaatttattgagagtttttagcatgaaaggctgttggattttgtcaagggccttttctgcatctattgagataatcatgtggtttttgtctttggttctgtttatatgctggattacatttattgatttgtgtatgttgaaccagccttgcatcccagggatgaagcccacttgatcatggtggatgagctttttgatgtgctgctggattcggtttgccagtattttattgaggaattttgcatcgatgttcatcagggacatttgtctaaaattctcctttttgttgtgtctctgccaggctttggtatcaggatgatgctggcctcataaaatgagttagggaggattccctctttttctattgattggaatagtttcagaaggaaaggtaccagctccttcttttacctctggtagaattcggctgtgaatctgtctggtcctggactttttttggttggtaggctattaattattgcctcaatttcagagcctgtttttggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggatcggtggtgatatcctatttatcattttttattccatctatttgattcttctttgttttcttcattagtcttgctagtggtctctcaattttgttgatcttttcaaaaaaccagctcctggattcgttaattttttgaagggttttttgtgtctctatttccttcagttctgctctgatcttagttatttattgccttctgctagcttttgaatgtatttgctcttgcttctctagttcttttaattgtgatgttagggtgtcaattttagatctttcctgctttctcttgtgggcatttagtgctataagtttccgtctacacactgctttaaatgtgtcccagagattctggtatgttgggtctttgttctcattggtttcaaagaacatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgttataatttctgctcttttacatttgctgaggagtgctttacttccaactatgtagtcaattttggaataagtgcgatgtggtgctgagaagaatgcatattctgttgatttgggatggagagttctgtagatgtctattagatctgcttggtgcagagctgagttcaattcctggatatccttgttaactttctgtctcgttgatctgtctcttgttgacagtggggtgttaaagtctcccattattattgtgcgggagtctaagtctctttgtaggtctctaaggacttgctttatgaatctgggtgctcctgtattgggtgcatatatatttaagatagttagctcttcttgttgcattgatccctttaccattatgtaatggccttctttgtctcttttgatctttgttggtttaaagtctgttttatcagagactaggattgcaacccctgcctttttttgttttctatttgcttggtagatcttcctccatccctgtattttgatcctatgtgtgtctctgcaagtgagatgggtctcctgaatatagcacactgatgggtcttgactctttatccaatttgccggtctgtgtcttttaattggagcatttagcccatttacatttaaggttaatattgttatgtgtgaatttgaccctggcattatgatgttagctggtgattttgctcgttagctgatgcagtttcttcctagccttgatggtctttacaatttgtcatgtttttgcagtggctggtaccggttgttcctttccatgtttagtgcttccttcaggagctcttgtagggcaagcctggtggtgacgacatctctcagcatttcctttctttaaggtatttcatttctccttcgcttatgaagcttagtttggctggatatgaaattctgggttgaaaattcttttctttaagaatgttgaatattggcccccactctcttctggcttgtagagtttctgctgagagatccactgttagtctgatgggtttccctttttgggtaacccaacctttctctctggctgcccttaacattttttccctcatttcaactttggtgaatctgacaattatgtgtcttggagttgctcttctcgaggagtatctttgtggcagtctgtttatttcctgaatttgagtgttggcctgtcttgctaggttggggaagttctcctgcataatatcctgcagagtgttttccaacttggtttcattctccctgtcactttcaggtacaccaatcagacgtagatttggtcttttcacatagtcccctatttcttggaggctttaattcatttcttttcactcttttttctctaaacttcccttgtcgcttcatttcattcatttgatcttcaatcactgacacccttccttccagttgatcaaatcggctactgaagcttgtgcattcatcacatagttctcgtgccttggttttcagctccatcaggtcatttaaggacttctctacactggttattctagttagccattcgtctaatcttttttcaaggtt

SEQ ID NO: 12823 - DNA, 4994 bp, Homo sapiens
  misc_feature (4720)..(4720): n equals a,t,g, or c
ttttagggggttattgacattttattttattttattttttattatactttaagttctagggtacatgtgcacagtgtgcaggtttgttacatatgtatacatgtgccatgttggtgtgctgcacctattaacttgtcatttaacattaggtatatctcctaatgctttccttcccccttccccccaccccacaacaggccccagtgtgtgatgttccccttcctatgtccaagtgttctcattgttcagttcccacctatgagtgagaacatgcggtgtttggttttttgtccttgtgacactttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttactattgtgaatagtgctgcaataaacatacgcgtgcatgtgcctttatagcagcatgatttataatcctttgggtatatacccagtaatgggatggctgggtcaaatggtatttctagttctagatccctgaggagtcgccacactgacttccacaatggttgaactagtttacagtcccaccaacagtgtaaaagtgttcctatttctccacatcctctccagcacctgtggtttcctgaactttttaatgattgccattgtaactggtgtgagatggtatctcattgtggttttgatttgtatttctctgatagccagggatgatgagcattttttcatgtgtcttttggctgcataaatgtcttcttttgagaagtgtctgttcatatccttcgcccacttgttgatggggttgtttgtttttttcttgtaaatttgttggagttctttgtatattctggatattagccctttgtcagatgagtagattgcaaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcctctagggtttttatggttttaggtctaacatttaagtctttaatccatcttgaattaatttttgtataagatgtaaggaagggatccagttccagctttctacatatggctagccagttttcccagcaccatttattaaatagggaatcctttccgcatttcttctttttgtcaggtttgtcaaagatcagatggtcgtagatgtgtggtattatttctgagggctctgttctgttccattggtctatatctctgttttggtaccagtaccatgctgttttggttactgtagccttgtagtatagtttgaagtcaggtagcgtgatgcctccagctttgttctttgggcttaggattgtcttggtaatgcgggctcttttttggttccatatgaactttaaagtagttttttccaattctgtgaagaaagtcattggtagcttgatggggatggcattgaatctataaattaccttgggcagtgtggccattttcacaataatgattcttcctatccatgagcatggaatgttcttccatttgtttgtatcctcttttatttcattgagcagtagtttgtagttctccttgaagaggtccttcacatcccttgtaagttggattcctaggtattttattctctttgaagcaagtgcgaatgggacttcactcatgatttggctctctgtttgtctgttattggtgtataagaatgcttgcgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgattgccctggccagaatttccaacactatgttgaataggagtggtgagagagggcatccctgtcttgtgccagttttcaaagggaatgcttccagtttttgcccattcagtatgatattggctgtgggtttgtcataaatagctcttattattttgagatacatctcatcaatgcctaatttattgagagtttttagcatgaagggctgttgaattttgtcaaaggccttttctgcatctattgagataatcatgtggcttttgtctttggttctgtttatatgctggattacgtttattgatttgcatatgttgaaccagtcttgcatcccagggatgaagcccacttgatcatggtgggtaagctttttgatgtgctgctggatttggtttgcccgtattttattgaggatttttgcatcgatgttcatcaaggatattggtctaaaattctctttttttgttgtgtctctgccaggctttggtatcatgatgatgctggcctgataagatgagttagggaggattccctctttttctattgattggaatagtttcagaaggaatggtaccagctcctccttgtacctctgatgaattcggctgtgaatccgtctggtcctggactttttttggttggtaggctattaattattgcctcaatttcagagcctgttattggtctattcagggattcaacttcttcgtggtttaatcttgggagggtgtatgtgtccaggaatttatccatttcttctagattttctagtttatttgcatagagatgtttatagtattctctgatactagtttgtatttctgtgggatcggtggtgatatcccctttgtcactttttattgtgtctatttgattcttctctcttttcttctttattagtcttgctagcggtctatctattttgttgatcttttcaaaaaaccagctcctggattcattgattttttgaagggttttttgtgtctctatctccttcagttcttctgtgatcttagttatttcttgccttctgctagcttttgaatgtgtttgctcttgcttctctagttcttttaattgtgatgttaggttgtcagttttagatgtttcctgctttctcttgtgggcatttagtgctgtaaatttccctctacacactgctttaaatgtcccagagattctggtatgttgtgtcgttgttctcattggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgaaagactgtttgttataaattctgttctcttacatttgctgaggagtcctttacttccaactatgtggtcaattttggaataagtgtgatgtggtgctgcgaagaatgtatgttctgttgatatgtggtgtagagtgctgtagatgtctattgggtctgcttggtgcagagctgagttcaattcctggatatccttgttaactttctgtctcgttgatctgtctaatgttgacagtggggtgttaaagtctcccattattagtgtgtgggagtctaagtctctttgtagatctctaaggacttgctttatgaatctgggtgctcctatattgggtgcatatatatttaagatagttagctcttcttgttgaattgatccttttaccattatgtaatggccttctttgtctcttttgatctttgttggtttaaagtctgttttatcagagactaggattgcaaccactggtttcttttgctttccatttgcttggtagatcttcctccatccctttattttgagcctatgtgtgtctctgcacgtgagatgggtctcctgaatacagcgcactgatgggtcttgactctttgtccaatttgccagtctgtgtcttttaattggaacatttagcccatttacatttaaggttaatattgttatgtgtgaatttgatccactccttatgatgttagctggttattttgctcgttagttgatgcagtttattcctagcatcgatgatctttacaatttgtcatgtttttgcagtggctggtactggttgttcctttccatgtttagtgcttccttcaggagctcttgtaaggcaggcctggtggtgacaaaatctctcagcatttgcttgtctgtaaaggattttatttctccttcgcttaagaagcttagtttggctggatatgaaattctgggttgaaaattcttttccttaagaatgttgaatattggcccccactctcttctgggttgtagagtttctgctaagagatccgctgttagtctgatgggtttccctttgtgggcaacccgacctttctctctggctgcccttaacattttttccttcatttcaactttggtggatctgacaattgtgtgtcttggagttgctcttctcgaggagtatctttgtggcattctctgtatttcctgaatttgaatgttggcctacctttctgggttggggatgttctcctggataatatcctgcagagtgttttcgaacttggttccattctccccgtcacttttaggtacaccaatcagacgtagatttggtcttttcacatagtcccatatttcttggaggctntgttcatttctctttactcttgtttctctaaacttctcttctcacttcatttcattcatttaatcttcaatcactgataccctttcttccagttgattgaatcggctactgaagcttgtgcattcgtcatgtagttctcgtgccatggttttcagctccgtcaggtcatttaaggacttctctaccccgattattctcgttagccattcttctaatcttttttcaaggtttttagcttctttgccatgggttcgaacttcctcctttagctcgg

SEQ ID NO: 12824 - DNA, 6083 bp, Homo sapiens
tggtcctcttgttttttttttttatttttttatttttttatttatttattttttattatactttaagttttagggtacatgtgcacattgtgcaggttagttacatatgtatacatgtgccatgctggtgcgctgcacccactaactagtcatctagcattaggtatatctcccaatgctatccctccccccctccccccaccccaccacagtccccagagtgtgatattccccttcctgtgtccatgtgatctcattgttcagtccccacctatgagtgagaatatgccgtgattggttttttgttcttgtgatagtttactgagaatgatgatttccagtttcatccatgtccctacaaaggacacgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcacgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgtcttcttttgagaagtgtctgttcatgtcctttgcccactttttgatggggttgtttgtttttttcttgtaaatttgtttgagttcattgtagattctggatattagccctttgtcagatgagtagcttgcgaaaattttctcccattttgtaggttgcctgttcactctgatggtagtttcttttgctgtgcagaagctcttgagtttaatgagatcccatttgtcaattttggcttttgttgccattgcttttggtgttttggacatgaagtccttgcccatgcctatgtcctgaatggtaaatgcctaggttttcttctagggtttttatggttttagctctaatgtttaaatctttaatccatcttgaattgttttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctgtaaattaccttgggcagtacggccatttttatgatactgattcttcctacccatgagcatggaatgttcttccatttgtttgtatcctcttttatttccttgagcagtggtttgtagttctccttgaagaggtccttcacatcccttgtaagttggattcctaggtattttcttctctttgaagcaattgtgaatgggagttcactcatgatttggctctccgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgtttccttctcctgcctaattgccctggccagcacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctcttgagataatcatgtggtttttgtctttggctctgtttatatgctggattacatttattgatttgcgtatattgaaccagccttgtgtcccagggatgaagcccacttgatcatggtggataagctttttgaagtgctgctggattcgttttgccagtattttattgaggatttttgcatcaatgttcatcaaggatattggtctaaaattctctttttttgttgtgtctctgcctggctttggtatcagaatgatgctggccctcataaaatgagttagggaggattccctctttttctattgattggaatagtttcagaaggaatggtaccagttcctccttgtacctctggtagaattcagctgtgaatccatctggtcctggactctttttggctggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatattagtttgtatttctgtgggattggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctatcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatttgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgttaagtattttatttctccttcacttatgaagcttagtttggctggatatgaaattctgggttgaaatttcttgtctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgaccattatgtgtcttggagttgctcttctcgagaagtatctttgtggcattctctgtgtttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctctcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctgagagtaatttgatcgtctgaagccttcttctctcagctcgtcaaagtcattctccatccagctttgttccgttgttggtgaggaactgcgttcctttggaggaggagaggcgctctgcgttttagagtttccagtttttctgttctgttttttccccatctttgtggttttatgtacttttggtctttgatgatggtgatgtacagatgggtttttggtgtggatgtcctttctgtttgttagttttccttctaacagacaggaccctcagctgcaggtctgttggaataccctgcagtgtgaggtgtcagtgtgcccctgctggggggtgcctcccagttcggctgctaggaggtcaggggtcagggacccacttgaggaggcagtctgccagttctcagatctccagctgcgtgctgggagaaccactgctctcttaaaagctgtcagacagggacatttaagtctgcagaggttactgctgtccttttgtttgtctgtgccctgcccccagaggtggagcctacagaggcaggcaggcctccttgagctgtggtgggctccacccagttcgagcttcctggctgctttgtttacctaatcaagcctgggcaatggcgggtgcccctcccccagcctcactgccgccttgcagtttgatctcagactgcagtgctagcaatgagcgagactccgtgggtgtaggaccctccgagccaggtgcgggatataatcttgtggtgcgccgttttttaagcccgtcggaaaagcgcagtattcgggtatgagtgacccgattttccaggtgccgtccgtcacccctttctttgactcggaaagggaactccctgaccccttgcgcttcccaagtgaggcaatgcctcgccctgtttcggctggcgcacggtgtgcgcacccactctcctgcacccactgtctggcactccctagtgagatgaacccggtacctcagatggaaatgcagaaatcaccatcttctgcgttgctcaggctgggagctgtagacaggagctgttcctattcggccatcttggctcctctcttcaaaaat

SEQ ID NO: 12825 - DNA, 6162 bp, Homo sapiens
gtttcctttttttattattattatactttaagttttagggtacatgtgcacaatgtgcagtttagttacatatttatacatgtgccatgctggtgtgctgcacccattaactcgtcatttagcattaggtatatttcctaaagctatccttccccctccccccacaccacaacagtccccagagtgtgatgttccccttcctgtgttcatgtgttctcattgttcaattcccacctatgagtgagaatatgcggtgtttggttttttcttcttgcgataatagtttactgagaatgatgatttccaatttcatccatgtccctacaaaggacatgaactcatcattttttatggctgcatagtattccatgctgtatatgtgccacattttcttaatccagtctatcattgttggacatttgggttggttacaagtctttgctattgtgaatagtgccgcaataaacatacgtgtgcatgtgtctttatagcagcatgatttatagtcctttgggtatataccgagtaatgggatggctgggtcaaatggtatttctagttctagatccctgaggaatcgtcacactgacttccacaatggttgagctagtttacagtcccaccaacagtgtaaaagtgttcccatttctccacatcctctccagaacctgttgtttcctgactttttaatgattgccattgtaactggtgtgatatgatatctcattgtggttttgatttgcatttctctgatggccagtgatggtgagcattttttcatgtgttttttggctgcataaatgtcttcttttgagaagtgtctgttcatgtccttcgcccactttttgatgaggttgtttgtttttttcttgtaaatttgtttgagtccattgtagattctggatattagccctttgtcagatgagtaggttgcgaaaattttctcccattttgtaggttgcctgttcactctgatggtagtttcttttgctgtgcagaagcgcttgagtttaattagatcccatttatcaattttggcttttgttgccattgcttttggtgttttagacatgaagtatttgcccatgcctatgtcgtgaatggtaatgctaaggttttcttctaggatattttatgattttaggtctaacgtttaagtctttaatccatcttgaattaatttttgtataaggtgtaaggaagggatccagtttcagctttctacatatgtctagccagttttcccagcaccatttattaaatagggaatcctttccccattgcttgtttttctcaggtttgtcaaagatcagatagttgtagataagcggtgttatttctgagggctctgttctgctccattgatctatatctctgttttggtaccagtaccatgctgttttggttactgtatccttgtagtatagtttgaagtcaggtagcatgatgcctccagctttgttcttttggcttaggattgactttgcgatgcgggctcttttttggtttcatatgaactttaaagttgttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgaggagtggtttgtagttctccttgaagaggtccttcacatcccttgtaaggtggattcctaggtattttattctctttgaagcaattgtgaatgggagttccctcatgatttggctctctgtttgtctgttattggtgtataagaatgcttgtgatttttgtacattgattttgtatcctgagactttgctgaagttgcttatcagcctaaggagattttgggctgagacaatggggttttctagatatacaatcatgtcatctgcaaacagggacaatttgacttcctcttttcctaatccaataccctttatttccttctcctgcctaattgccctggccagaacatccaacactatgttgaataggagtggtgagagagggcatccctgtcttgtgccagttttcaaagggaatgcttccagtttttgcccattcagtatgatattggctgtgggtttgtcatagatagctcttattcttttgagatatgtcccatcaatacctaatttattgagagtttttagcatgaagcgttgttgaattttgtcaaaggccttttctgcatctattgagataatcatgtggtttttgtctttggttctgtttatatgctggattacatttattgatttacatatattgaaccagcctttcatcccatggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcctaaaatgaggtagggaatcctctttttctgttgattggaatagtttcagaagcaatggtaccagttcctccttatacctctggtagaatttggctgtgaatccatctggtcctggactctttttggttggtaaggtattgattattgccacaatttcagagcctgttattggtctattcagagattcaacttcttcctggtttagtcttgggagggtgcatgtgtcaaggaatttatccatttcttctagattttctagtttatttgtgtagaggtgtttgtagtattctctgatggtagtttgtatttctgtggaatcagtggtgatatcccctttatcattttttattgcatctatttgattcttctctcttttcttctttattagtcttgctagtggtctatcaattttgttgatcctttcaaaaaaccagctcctcgattcattaattttttgaagggttttttgtgtctctatttccttcagttctgctctgattttagttatttcttgccttctgctagcttttgaatgtgtttgctcttgcttttctagttcttttaattgtgatgttagggtgtcaattttagatctttcctgctttctcttgtgggcatttagtgctataagtttccctctacacactgctttgaatgtgtcccagagattctggtatgttgtgtctttgttctcatcggtttgaaagaccatccttatttctgccttcatttcattatgtacccagtagtcattcaggagcaggttgttcagtttccatgtagttgagcggttttgactgagttttgtaatcctgagttctagattgattgcactgtggtctgagagatagtttgttataatttctgttctttacagttgctgaggagagctttgcttccaactatgtggtcaattttgggataggtgtggtgtggtgctggaaaaaatgtatattctgttgatttggggtggagagttctgtagatgtctgttaggtcctcttggtgcagagctgagttcaattcctgagtatccttgttgactttctgtctcgttgatctgtctaatgttgacagtggggtgttaaagtctcccattattaatgtgtgggagtctaagtctctttgtaggtcactcaggagttgctttatgaatctgggtgctcctgtattgggtgcatatatatttaggatagttagctcttcttgttgaattgatccctttaccattatgtaatgtccctctttgtctcttttgatctttgttggtttaaagtctgttttatccgagactaggattgcaacccctgcccttttttgttttccatttgcttggtagatcttcctccatccttttgttttgagcctatgtgtgtctctgcatgtgaggtgggtttcctgaatacagcacactgatgggtcttgactctttatccaatttgccagtctatatcttttaattggagcatttagtccatttacatttaaagttaatattgttatgtgtgaatttgatcctgtcattatgatgttagctggctattttgctcgttagttgatgcagtttcttcctagcctcgatggtctttacaatttggcatgattttacagtgactggtactggttgttcctttccatgtttagtgcttctttcaggagttcttttagggcaggcctggtggtgaaaaaatctctcagcatttgcttgtctgtaaaggattttatttctccttcacttatgaagcttagtttggctggatatgaaattctgggttgaaaattcttttctttaagaatgctgaatattggcccccagtctcttctggcttgtagagtttctgccgagacatctgctgttagtctgatgggcttccctttgtgggtaacccgacctttctctctggctgcctttaacattttttccttcatttctactttggtgaatctgataattatgtgtcttggagttgctcttctcaataagtatctttgtggcattctctgtatttcctgaatctgaatgttggcctgccttgctagattggggaagttctcctggataatatcctgcagagtgttttccatcttggttccattctccctgtcactttcaggtacaccaatcagacgtagatttggtcttttcacatagtcccatatttcttggaggcttttttcgtttctttttattcttttttctctaaactttccttctcacttcatttcattcatttcatcttccatcactgataccctttcttccagttgatcgcattggctcctgaggcttctgcattcttcacgtagttcttgagccttggctttcagctccattagctcctttaagcacttctctgtattggttattctagttatacatttatctaaatttttttcaaattttcaacttccttgcctttggtttgaatttcctcctgtagctcagattagtttgattgtctgaggccttcttctctcaactcgtcaaagtcattctccgtccagctttgttccgttcctggtgaggagctgtgttcctttggaggaggagaggcgctctgctttttagagtttccagtttttctgctctattttttccccatctttgtcgttttatctacttttggtctttgatgatggtgatgtacagatgggtttttggtgtggatgtcctttctgtttgttagttttccttctaacagacaggaccttcagctgcaggtctgttggagtttgctagaggcccactccagaccctatttgcctgggtaccagcaacggtggctgcagaacaggggatttttgtgaaccaaaaatgctgctgtctgatcgttcctctggaagttttgtctcagaggagtacccggccatgtgcagtgtcagtctgcccctacttgggggatgcctcccaggtaggctgctcgtggttcagggatcagggacccacttgaggaggcagtctgcccattctcagatcaccagcttcatgctgagagaaccactgctctcttcaaagctgtcagacagggacatctaagtctgcagacgttactgctgtctttttgtttgtctgtgcccttcccacagaggtggagcctacagaggcaggcaggcctccttgagctgtggtgggctccacccagttcgagcttcctggctgttttgtttacctaagcgagcctgggcaatggcgggtgcccctcccccagccttgctgccaccttgcagtttgatctcagactgctgtgctagcaatcagtgagactccatgggcgtaggaccgtctgagccaggtgcgggatataatctcctggtgcaccattttttaagcccgtctgaaaagcgaagtattagggtgggagtgaccccattttccaagtgccgtctgtcacccctttctttgactaggaaagggaactccctgtccccttgcgcttcccgagtgaggcaatgcctcgccctgctttggctggtgcacggtgtgctgcacccactgtcttgcgcccactgtctggcactccctagtgagatgaacccggtacctcagatggaaatgcagaaatcacgcatcttctgcatcgctcatgctgggagctgtagactggagctgttcctattcggccatcttggctcccg

SEQ ID NO: 12826 - DNA, 6033 bp, Homo sapiens
ttctttttttttattattattattattatactttaagttttagggtacatgtgcacattgtgcaggttagttacatatgtatgtatacatgtgccatgctggtgtgctgcacccactaactcgtcatctagcattaggtatatctcccactgctatccctcccccctccccccaccacaccacagtccccagagtgtgattgttccccttcctgtgtccacgtggtctcattgttcaattcccacctatgagtgagaatatgcggtgtttggttttttgttcttgggatagtttactgagaatgacgatttccaatttcatccatgtccctaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcccatttctccacatcctctccagcacctgttgtttcctgactttttaatgatcgccattctaactggtgtaagatggtatctcattgtggttttgatttgcatttctctgacggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggaatgacttggcaatgcgggctcttttttggttccatatgaactttaaagtagtttttcccaattctgtaaagaaaggcattggtagcttgatggggatggcattgaatctgtaaattaccttgggcagtatggccattttcacgatattgattcttcctacccatgagcatggaatgttcttccatttgtttgtgtcctcgtttatttccttgagcagcggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagcttttagcatgaagcattgttgaattttgtcaaaggccttttctgcatctattgagataatcatgtggtttttgtctttggctctgtttatgtgctggattacatttattgatttgcgtatattgaaccagccttgcatcccagggatgaagcccacttgatcatggtggataagctttttgatgtgctgctggatttggtttgccagtattttattgaggatttttgcatccatgttcatcaaggatattggtctaaaattctcttttttggttgtgtgtctgcccggctttggtatcagaatgatgctggcctcagaaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcacatcctgttattggtctattcagagattcaacttcttcgtggtttagtcttggaagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttcaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatatctgccttcatttcgttatgtacccagtagtcatttaggagcaggttgttcagtttccatgtagttgagcagttttgagtgagattcttaatcctgagttctagtttgattgcactgtggtctgagagacagtttgttttaatttctgttattttacatttgctgaggagagctttacttccaagaatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggcttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttggttgatgcagtttcttcctagtctcgatggtctttacattttggcatgattttgcaagcggctggtaccagttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagattcgctgttaagtctgatgggcttccctttgagggtaaccgacctttctctctggctgcccttaacaattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttcttttttctctaaactttccttctcgcttcatttcattcatttcatcttccattgctgataccttttcttccagttgatcgcagcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatctgatcgtctgaagccttcttctctcagctcgtcaaagtcattctccgtccagctttgttccgttgctggtgaggagctgcgttcctttggaggaggagaggcactctgatttttagagtttccagtttttctgttcagttttttccccatctttgtggttttatctacttttggtctttgatgatggtgatgtacagatgggtttttggtgtggatgtcctttctgtttgttagttttccttctaacagacaggaccctcagctgcaggtctgttggagaaccctgcagtgtgaggtatcagtgtgcccctgctggagggtgcctcccagttaggctgctcggggctcaggggtcacggacccacttgaggaggcagtctgcccgttctccgatctccagctgcctactgggagaaccactgctctcttcaaagctgtcagacagggacatttaagtctgcagaggttactgctgtctttttgtctgtgccctgcccccagaggtggagcctacagaggcacgcaggcctccttgagctgtggtgggctctacccagttcaagcttcccggctgctttgtttacctaagcaagcctgggcaatggtgggtgcccctcccccagcctcggtgctgccttgcagtttgatctcagactgctgtgctagcaatcagcgagactccatggggtaggaccctccgagccaggtgcgggatataatctcgtggtgcgccgttttttaagcccgtcggaaaagcgcagtattcgggtcgggtgggagtgacccgattttccaggtgccgtcggtcacccctttctttgattaggaaaggcaactccctgacctcttgcacttcccaagtgaggcaatgcctcgccctgcttcggctcacacacggtgcgcgcacccactgacctgcgcccactgtctggcactccctagtgagatgaacctggtaccacagatggaaatgcagaaatcacccgtcttctgcgtagctcaggctgggagctgtagaccggagctgttcctattcggtcatct

SEQ ID NO: 12827 - DNA, 6147 bp, Homo sapiens; identical to SEQ ID NO: 12571

SEQ ID NO: 12828 - DNA, 6069 bp, Homo sapiens
taatagttttttttttcttttttttttttttaatttttttttttattatactctaagttttagggtacatgtgaacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatgggatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcgacattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatatcgattcttcctacccatgagcatggaatgttcttccatttgtttgtgtcctcttttatttccttgagcagtggtttgtagttctccttgaagaggtccttcctatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggggttttctagataaacagtcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttatggaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtcgtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggctttcctttgagggtaacccgacctttctctctggctgcccttaacgttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcccacagaggcaggcaggcctccttgagctgtggtgggctccacccagttcgagcttcccggctgctttgtttacctaagcaagcctgggcaatcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctccacatcca

SEQ ID NO: 12829 - DNA, 6050 bp, Homo sapiens
gttataaataattcatgtgatttttttttattattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctaccatagatggacatttgggttggttccaagtctttgctattgtgaataatgccgcaataaacatacgtgtgcatgtgtctttatagcagcatgatttattctcctttgggtatatacccagtaataggatggctgggtcaaatggtatttctagttctagatccctgaggaattgccacactgacttccaccatggttgaactagtttacagtccccccaacagtgtaaaagtgttcctatttctccacgtcctccccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcataagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcacctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacgtggcgatgcgggctccttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttatacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattctctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttctacctggtttagtcttgggagagtgtatgtgtccaagaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatcaattttgttgaccctttcaaaaaaccagttcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaatttgggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttaagtgagattcttaatcctgagttctagtttgattgcactgtggtctgagagatagtttgttataatttccgttcttttacatttgctgaggagagctttacttcccagtatgtggtcaattttggaataggtgtggtgtggtgctgaaaaaaatgtatattctgttgatttggggtggagagttctgtagatgtctattaggtccgcctggtgcagagctgagttcaattcctgggtatccttgttgactttctgtctcgttgatctgtctaatgttgacagtggggtgttaaagtctcccattattaatgtgtgggagtctaagtctctttgtaggtcactcaggatttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggctgggtagatcttcctccacccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgctatgtgtgaatttgatcctgtcatgatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattctttcctttaagaatgttgaatattggcccccactctcttctggcttgtagggtttctgctgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtattttctgaatctgaacgttggcctgccttgctagattggggaagttctcctggataatatcctacagagtgttttccaacttggttccattctccccatcacttttaggtacaccaatcagacgtagatttggtcttttcacatagtcccatatttcttggaggctttgctcatttctttttattcttttttctctaaacttcccttctcgcttcatttcattcatttcatcttccattgctgataccctttcttccggttgatcacatcagctcctgaggcttctgcattcttcacgtagttctcgagccttggttttcagctccatcagctcctttaagcacttctctgtattggttattcttgttatacattcttctaaatttttttcaaagttttcaacttctttgcctttggtttgaatgtcctcccatagctcagagtaatttgatcgtctgaagccttcttctctcagcttgtcaaagtcattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagttctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctgtctgctttgtttacctaatcaagcctgggcaatggcgggcgcccctcccccagcctcactgccgctttgcagtttgatctcagactgctgtgctagcaatcagcgagactccgtgggcgtaggaccctccgagccaggtgcaggatataatctcgtggtgcgccgttttttaagcccgtcggaaaagcgcagtattcgggtgggagtgacccgattttccaggtgccgtccgtcacccctttctttgactcagaaagggaactccctgaccccttgcgcttcccaagtgaggcaatgcctcgccctgcttcggctcgcgcacagtggacgcacccactgacctgcacccactgtctggcactccctagtgagatgaacccggtacctcagatggaaatgcagaaatcacccgtcttctgcgtcgctcacgctgggagctgtagaccagagctgttcctattcggccatcttggctcctcctcga

SEQ ID NO: 12830 - DNA, 30515 bp, Homo sapiens
tttacatttttattttatttttttttaatttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtaatctcattgttcaattcccacctatgagtgagaatatgcggtgtttgctttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcattctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacgtatggctagccagttttcccaccaccatttattaaatagggaatcctttccccattgcttgtttttgtcaggtttgtcaaagatcagatagctgtagatatgtggcgttatttctgagggctctggtctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcctgtcagcttaaggagattttgggcttgagacaatggggttttctagatatacaatcatgtcgtctgcaaacagggacaatttgacttcctcttttcccaattgaataccctttatttccttctcctgcctaattgcccaggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatgcctaatttattgagagtttttagtatgaagggttgttgaattttgtcaaaggcttttttctgcatctattgagataatcatgtggtttttgtctttggctctgtttatatgctggattacatttattgatttgcgtatattgaaccagccttgcatcccagggatgaagcccagttgatcatggtggataagctttttgatgtgctgctggattcgttttgccagtattttactgaggatttttgcatcaatgttcatcaaggatattggtctaaaattctctttttttgttgtgtctctgcctggctttggtatcagaatgatgctggcctcataaaatgagttagggaggattccctctttttctgttgattggaatagtttcagaaggaatggtaccagttcctccttatacctctggtagaattcggctgtgaatccatctggtcctgtactctttttggttggtaagctattgattattgccacaatttcagctcctgttattggtctattcagagattcaacttcttcctggtttagtcttgggagagtttatgtgcagaggaatttatccatttcttctagattttctagtttatttgcatagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcttttcaaaaaacaagctcctggattcattaatttattgaagggttttttgtgtctctgtttccttcagttctgctctgagtttagttatttcttgccttctgctagcttttgaatgtgtttgctcctgcttttctagttcttttaattgtgatgttaggttgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatatggggtggagagttctgtagatgtctattaggtctgtttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatgtccttctttgtctcttttgatctttgttggtttaaagtctgttttatcagagactaggattgcaacccctgcctttttttgttttccattggcttggtagatcttcctccatccttttattttgagcctctatgtgtctctgcacgtgagatgggtttcctgaatacagcacactgatgggtcttgactctttattcaatttgccagtctgtgtcttttaattggagcatttagtccatttacatttaaagataatattgttatgtgtgaatttgatcctgtcattatgatgttagctggttattttgctcgttagttgatgcagtttcttcctagtctcaatggtctttacattttggcatgattttgaagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgccttctcgaggagtatctttgtggtgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagtaatacattctcctaaatttttttcaaagttttcaactgctttgcctttggtttgaatgtcctcccgtagctcagagtaatttgatcatctgaagtcttctctcagcttgtcaaagtcattctccatccagctttgttccgttgctggtgaggaactgcgttcctttggaggaggagaggtgctctactttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggtgcctcccagttaggctgttctggggtcaggggtcagggacccacttgaggaggcagtctgcccgttctcagatttccagctgcgtgctgggagaaccacagctcttttcaaagctgtcagacagggacatttaagtatgcaaaagttactgctgtctttttgtttgtctgtgccctgcccccagaggtggagcctatagaggcaggcaggcctccttgagctgtggtgggctccacccagttcgagcttcccggctgctttgtttacctaagcaagcctgggcaatggcgggcacccctcccccagccttgctgccgccttgcagtttgatctcagactgctgtgctaacaatcagcgagactccgtgggcgtaggaccctccgagccaggtgcgggatataatcttgtggtgcgcagttttttaagcccgtccgaaaagcgcagtgttcgggtgggagtgacccgactttccaggtgccgtccatcacccctttctttgactcagaaagggaaccccctgaccccttgcgcttcccaagtgaggcagtgcctcgccctgcttcggctgaggcacggtgcgtgcgcccactgacctgcgcccactgtctggcactccctaatgagatgaacccggtacctcagatggaaatgcagaaatcacccgtcttctgcgtcgctcacgctgggagctgtagaccggagctgttcctattcggccatcttggctcctcccctcaggaaatgtcttaagtaacataaaatgtgctttgtgagtaaatgttaacagtaaagttactgggaatgtaaaatccctcttattttatgcagtgtatgcactgagatctacatgcctcagtctcagtgtagatctgtgtacttttcattagtgtttgtactttcattaatttcctgtatgttgattttcttttccttttcttttttcctagtttacttctacaatttcggatggaaggattatggtgtagcgtctcttactactatcctagatatggtgaaggtgatgacatttgccttacaggaaggaaaagtagctatccattgtcatgcagggcttggtcgaacaggtaggtcctaagaggtggtttattgcctgtaggcatatttaaacataaaaggaataagatttcctaatttgagggtaaatgtttctcagaatcctatcaaagctttggagtcaggtggaagaagggaataagttctagtgttctgtaccactgtagggtgtctatagttaaaatgatatatagtttcaaatagctagaaggaggatattgaatgttcccaacacaaatgcatgataaatgttgaagattatgcgtatactaaatacactgatctgatcactatacattatatgtattaaaacatcactatataccccatagatatgtataattattatgttaacattaaaaattaaatcaaaaaaaattttaagatatttgaaataccgtaaacaggtagttacaatgaccgtatatatatcattttaaagtctttagcaacaatgtgagttggagaaactgcaatttgagagaagtaatttgctacatttagtaagtgccagggccacactttaaatccatggttgtctgactccagagttcatgtgctttccatttttggaggtataaggattttgtttgtgaagaagagtctatctgtgcccagaattctattaaaaagtcagtgattttacttaaaacattcagctgaatttcattacagtgctgatattggggcaaaaatgaaggccgtagggctgaaattttcattgtcatctgatccaaccacatgcagctcagctctgtccgcagtgtacctgtgctcctgccaggggatctgccacatacctggaagcatgcgcaggggaggggactcagctctgcttgagattagtagctcttaggatcaagccaaaatctcactgtttctagacattgacatgatagctctgcagacattttacatttatactaagatcttctgtgtcctagtgagaaaggtatgttgttaccgactgtgaactggagagcatgcagttttcagaggttctgattttcatatgtaacaagatgttcacaaacttggggatcacacaggtgtatttgatttgccttttactttaatattaattgactgttatatttgaattaatttattaattattaccttttaactagtaataaccttactagttattccttttaattagatgttagtaagaatacctaatgtttataccactaagcctggcttccttaagattgcttaattttccataattgcttatggaaaaatagaattatatcatggtctgaaggaaaacacatattagtataggcacaatctggaaaaagaattgccaagaagaaaagtaggctgcaaatatgaataatccctaaagaagaaactgccgtggtagggagagtgccaagctgggatgtgccagcagttgatggcaaagatagcagggtgggaggttccaaacacaaagtgtatggattgattggatggaaattctcaagaactgttcagagtggaaaatagaaacaggatttgctttcttctgatggagttaagtagaacaaggaggatagatgggccagatgatcagtttcccttccctcctgcacacttactcacctaccttgtgcctgtgctggcacagctctgggctactgagatgactcagtcatggggaggcggtgccacatagacatttaataaagttctgtgcagtaaggaacgtgcaaaataacacctctacaaaaagtcacaaagttatcatcataattgtccttaaaatgtgtctctatttatatggtttcttaacacatattcaaattgtaaatcatcaaagagtgataaataaaataaataaaaatgtaagcttttctcataccagtcttctcttcttcactgtttaggtgttttaatagcctgttacttagtttttgcaacgagaatgactgctgaccaagcaattatatttgtgcgggcaaagcgacccaattccatacaaaccaagagacagctcctctgtgtaagggaatttactcagtttctaactcctctccgcaatatattctcttgctgtgatcccaaagcacatgctgtcaccttacctcaatatctaattcgccagcgtcatctgcttcatggttatgaggcacgacttctgaaacacgtgccaaaaattatccacctagtttgcaaattgctgctggacttagcggagaacaggccagtgatgatgaaggatgtgtccgaaggacctggtctctctgctgaaatagaaaagacaatgtctgagatggtcaccatgcagctggataaagagttactgaggcatgacagtgatgtgtccaacccgcctaaccccactgcagtggcagcagattttgacaatcgaggcatgattttctccaatgagcaacagtttgaccctctttggaaaaggcggaatgttgagtgccttcaacccctgactcatctgaaaaggcggctcagctacagtgactcagatttaaagagggccgagaacctcctggagcaaggggagactccacagacagtgcctgcccagatcttggttggccacaagcccaggcagcagaagctcataagccattgttacatcccacagtctccagaaccagacttacacaaggaagccttggttcgcagcacactttctttctggagtcagtcaaagtttggaggcctggaaggactcaaagataatgggtcaccaattttccatggaaggatcattccaaaggaagcacagcagagtggagctttctctgcagatgtttcaggctcacacagccctggggagccagtttcacccagctttgcaaatgtccataaggatccaaaccctgctcaccagcaagtgtctcactgtcagtgtaaaactcatggtgttgggagccctggctctgtcaggcagaacagcaggacaccccgaagccctctggactgtggctccagtcccaaagcacagttcttggttgaacatgaaacccaggacagtaaagatctgtctgaagcagcttcacactctgcattacagtctgaattgagtgctgaggcaagaagaatactggcggccaaagccctagcaaatttaaatgaatctgtagaaaaggaggaactaaaaaggaaggtagaaatgtggcaggtattattagtacttaatttaattatagatatgtgggaaatatttatgtcagggcaaaagtgtgatacattttcccaaacttatttattatagaaatgtgaagatacgtttgcataatactttctaacttcaggtttctcgtctctgatgcgaacctgatgttatagaaaaaacacagggtgtttgtatggtttcatttaaatctgcatactcaagaaagcacttggtgtgatgcttgacccacacaaggcattgatattagtagtttccttcttcctgggcctatgggggcaactggcccacagcagacagcattcgaaactgactagaagcatctttatgaggcctggcagagggaatcatactttgagaactactgacgtgcagacataaataaaatgtttatttttcaaagctcatcaacactggtgctgagcaaggtcagaagagtgaggctgtctctttggcatcctctccttcagacttgccaatcctgccctaatagggcaactatgggaaatcaggagagcaagtgggtgaaaccacagattactacgtgccattcactttagctgagttgaggtctttggggtccatttcttagcttttacttcaattagaatgtaaatgtttaactcttttttgtgttgtgcttttactaggatacagtcataagtcagccacactttctttgccctgaatgagcacctgttctcgagaaaagataggccttataaacctagctatgagaaacagctaaactaccccaaaaggaggctgacttggacagtcgtgaatcaccgagatcttgacttttgagcccataacctactgtgaattattttaatagctcgctttcatagtctgccattgattaaacaaggcatataaaatttctgagtgccagtatctcttcagttgcagaggcatgaaaattaagtttggagcttcacattaacttttaattatatgatgggaggagagaacttttgataaaaattttgttcttcagaattgtgtttcgcctatccaatagttaaatgtattgctttcttccaaaatgaattgttttctttattttctgctccaaactgaaaaagtctttcattcagtcagcaaatatttcctgggcattactgtgtgttaagagttagcaagaaagagagtcttctattttagatgaaaatctcgcacccccactcctgggtcagccccagtgcccatgcaagctctgctgtggtgatgaagcgttcaggacttggtttgggccagaccgtatgtagtgtatatgaaagcattttctggaggtgaacacagacctttaatcaggatagttttgcatttttttccattctagattttattttaggacttttagttatcaaaaaaatcagttgaattctggaaaagaataaaatgaacattatttgaatagtataatgccacccatgcctgtactagaccatttcacatatattatttcatgtgatttttcacagttatcatagaacatatctgtaaggcagatgatactatttctacagtctttgttaatcttgtgaattcagtatcacagatgaggatgctaaaggtcatgaaggttagagggtaagtgacttgctcagggtcacgtggcatgcgtgtggcagagtcagggtacagcacatgtgtttaacactttccattatcccaagattcttggctaacctccctggagagcctcaggaaacatcatgataagatagtcattttgctaagagcatttttgattagtgtcagttctgcccagcttgtctccttcataagattgaatcaagagctactttgttttatacatgatctatgggatatgaaggactgtgaataacaaagtattggtgtattcataagataataaagagaagcccagtaccagagggcccttgtggcataatagaaacagcacagactctggagtaaggcagaactgggtatgaacaccccctttgccattttctagcttttggctcctaggtgagttatttcatctttcttgagccccattatatgtattggtgaggaagctccctgctgggtgccatttgagagttagagataagacatgtattacagtctctgtcccactgtgtgcatgtagtaaatattgggtaggtgaatgaatgagtgaatggtagcaattattacacttaacttctattttgttaaaatgtatttgactcactaaaacataaatctgaaccctgtcagaaattcatgaaaatccttatctcacttttcccttgctctctgtgaggtaaagtattaaaatctcatgcttaaattttctctaggcatttggagtattagaaaaactttccagttatcttccctatgtcaaatttcaggactcggggcttattgttaaatcctacataggatgctaaaaagatatttcaaagaagtacatatgccccatttaccagctttcaagcacctttattttatttttgcagacttcgaagctcaaagcttttccttttccttagaccccaggttaatgtataaatgttcccttatttctactttctcatctaccatctactttattgcaaaaaaatagttctgttttgttcaccagaaggctgaaaaggaagactcttgtgaactgtttctgtggtttctgaataaagtagagaacttggattaactaagccctttccctgtgctataagctttaaccgaccttatctcagtcaatcagcccaacagcttgtgaagcaggggatgagtttcatagagagaaactggggcttacagaattcagtgtcttagtccagtgtccagcctggaagtggagaggctgggaggggtcccagttctgcactctggagcctgagtctttcactcttgtgggcagcgcaagaatcatgcagtgtcaaatggtgcacctccctctcctctccctgtctctgtctctgtctgtctgtctctttctcttcctttttagaaagagcttaattcccgagatggagcttgggaaagaatatgtggcgagagggaccctttcatcctatgcagcttgatgtggtcttgggtggagcaactgaaggagcctgtaatcaccaaagaggatgtggacatgttggttgacaggcgagcagatgccgcagaagcactttttttattagagaaggtaaagtggctgtaggaccagttaatgactgtaactgaggcccttagtttttcacgcagaaaaaaaaaatccattataaaaaaagagaattcacacagaatcccaaatctagatctaatttaatagtttttccaagagaagagaagaaactgatacccagtgtaaacacttagaaaatacaaaaataaaaacgagaactatccatagtcctgggagaggcactgcaaacattttcaaacattttaaacttaccaatatgtatattaacttgttaaaaatcattttaacatacaagtttatatttcatttttgcttaaagttataacatagctattttcctgtgaataatgtaagcttttcataaatattgactcttaacggatatgatgctgtaacacgagactgtgccataattaagcactgtttcactgttggttgtttgtttctacttatttgctgtgagcatgcatatgggaaaaattatgaattaggttgggatatgcactcattcgtatttttaaaaaggggtaggtgtcacacatatatacatgtatatataatttttatttgtaaaatatagatgttttctatattttatatataaaagatatatgtttaaaatagaggaaatatgtatatatgtataaaatatagaaggagaaataagaaactggtaatagtggtcacctttaggaaaagatattagaagacaatggatctaggaaacgggagaaattgtatgaatccttttatataatttatcatttttatccatacagagatactaaattttcagtttaaaacagggtttgtttttgtttttgtttttgtttgtttctttttttgagacatagttttgctcttgttgcccaggctggagtgcaatggcgcgatctcagctcactgcaacctctgccccccgggttcaagcgattctcctgcctcagcctcccgagtagctgggattacagcatgtgccaccacgcccggctaattttgtaattttagtggagacaggatttctccatgttggtcaggctggtctcaaactcccaacctcatgtgatccacccaccttggcctcccaaagtgctgggattacaggcatgagccaccatgccaggcctgtttttgttttaacaaacaatgttattgaataaccagccttgagttacctgctatgctccatgtaaacatctcctcagtttctaaatttcactaaaaatcttctgctgttactacacacacacacacacacacacacacacacggacacatggacggatgcacatgcagacatgcagatacatgtgttcacacacatgcacacagatacaatacacaatacacagacatgtgcgtgcctgcacacacacacatacactcacataccacagttatgcaatacatatcttttaagaagtgatttttcctgtatccgaagtccttttcttaggatattttctcagcaattaaatcacagagttaaaacaggagatggtgaaaaggcagattaatgtttggtaggtgactgggccaagcccttcaggacataatttacattttctcttctgtttatctcaataccccttagaggtagaggcccatttcacagacaaggaaagctgaggttgcatgcccaaggttggcaccacatgtcagagcagaattcaagctcagaccactttggcacaaagcccatgtgctttctattacataaggctgcctgttttatcctaattcaccctcgggcaattcacctagggcatttatattgcttcaggttttttactttcataggcgtcattgtaatgataatttgtgcttgcaggtgtttctttattatagattatgctcttagagtagattttcagagttgaaatttatgggtccctgtacattacatcttggatatgtattgctgaaggtgatggaatttcttctttgctaaggtaaacagcccccaggagtcaagtcagtggacacatttttaagtatcttacccccttaggttggaggctaagcacttaagcactgcattgctcctgggggactggggttgtccttgtccttttctttgtctacctgcctccctccatatcatatgcagtggctgggtacccagatcctgaccactcagtgcccagttaattagtccatgtatctctatgacatgtcaccatctactagactactgacatatccagaaacaacaagaatgggaaaatctattcagttcactgcaagagaaacacttggtttaaaagtgcactgatcttcaaatttagttttactttgtacaatagctagccagctttgatattatctcctgaaagcttttcaaattatattaacacataacaataaacatttgttgatgtttagatattttgttagatattttggcatttgacattatgagtacttggtcacaaaccaattcttgactctacgatagttttgaattgatttattgaggcattttttgaaaaattttttaaattttgatttctacaaaaacagggacagcaccagactattctctgcgtgttgcactgcatagtgaacctgcagacaattcccgtggatgtggaggaagctttccttgcccatgccattaaggcattcactaaggtgggtcatactcttcctttcccctctctgaaccacagatcagcatcatctttgtaaatcagaatccagaggtcaccgtcctcctctaaaataaaacatgtatgtgtatgttttcccttcatggaaatctgtttgacatttcttctaagtagttgcagagtcttgaccaaaaaaaaagtttccaaacaatgatcttaggaaaagctgaattgtgagttttttgaaggagaacgttggaacaaagagcttttatataaaagaaagagagaaacaactgagtgttgaatacatatttttagatcatgtgcctaatcagagtcagagaatctttgcttgtcgagtcagttctaccttgggtgtaagtaagaagccatctattgagaattaaacatcccacattgctaattcagtactgagtcctggttggcaaatcctaaggaaagagttaaaaaaaaggtttcctttctaaaagcccatccttttggatgcagcagtttttcctggctgaagaaagaagaagcagccaggttcatactgagagaaaagtttccccttaccccatcagctataatttgtttattacttctcattgatatgaaagtatctataatttgtttgttacctctcattgatatgaaagtgtcattaaacaaagaacccagcttttgaatgacaacatctgtggtaacattaatgataagaagttattatttatactcattaacaagttataaagattcttcctttttaatatttgtccagtctccttcccctccactctttccggagtgatgttcttacttcaggccttccttgttcctcatctggattctatggcactaaccactgacatcttttcaatctgttctccactgtttccagagtcagtagtctcaaatccaaaccgcgtggtcctttacatctgtatttacactttcatagactgagaggctacccaccatgtgaagaaggttgtggtttggtgtttaagaaagtaaacagagctgggagtggtggcttacgcctgtgatcccagcactttgggaggctgagatgggtggatcatgagatcaggagattgagaccatcctggccaacatggtgaaaccccatctctactaaagtacaaaaatttagctgggcatggtggtgtgcgcctgcagtcccagctactcaggaggctgaggtggaagaatggcttgaacccgggaggtggaggttgcagtgagccgaaatcgcgccactgcactccggcctggcaacagagcgagactctgtctcaaaaaaaaaaaaaaaaaagtggccaggcatggtggctcaagcctgtaatccaagcactttgggaggccaaggtgggcagatcacgaggtcaggagatcaagaccatcctggataacatggtgaaaccccatctctactaaaaagaaatacaaaaaaattaactgggtatggtggcaggcgcctgtagtcccagctactcgggaggctgaggcaggagaatggtgtgaacccgggaggcggagcttgcagtgagccaagattgcaccactgcactccagcctgggcgacagagcaagactccatctcaaaaaaaaaaaagtaaacaattcacaccattattaatgttaataaggagttttttgcaaaggggatagataatatagttatagataaaattaaattcctgagcttaactgaaaaaaatccttacgattggtctctctgaaagcagtaggaattctttacaacttcttttggccttttaaggggatacgaatgaaaagttagagataacagttgttcaaaatctgtctatagaaaatgttaggagacagttttccttgggtctctcatgtctcttcatagtctgatgagcagatgccctgaccactctctttgaggatcaactcttcactaatgtctggagagctctgcctggagagcagaaggcacacgttctgacttccaggataataaaaatgtttcccttcagggcaaaggttggcagatttgcttgcagcccccttgtgaaacattggagtttcctaagcttggggctcctcagctatgaggcaaaccccgtgcttgtgcagcctccacctaggcccttctgcattgcctccatgagacttgagagacaaggagaacccatgtgaacatgaagcacatgcagctgtgagaaataaaagttgtctgtctctgacccaggaatctcgtatcttctaccagtatccataacactggcaagctaacaggttaaggtctcagatcctttacagttgttgacagagggaacaacctttcatttgtcaaaatttatcagagagggagaaattccagaagcagagaagcagtgattgtgtgaccctgattctttcccagggagttacacattactctgggaatggggttgagggtgggtacttgctctggttctctgtcctgccatcactgctaacccagagtatggtaaacttgggtgaaaaatgcaaatatgtgtaaatagtgcgctcccatcaaggggaaaggaaatttactttatcaaggtggggtttgtttgtttgtttgtttgtttgtttgttttttgagacaaggtctcactctgtcacccagtctggagtgcagtggcacaatctcagctcactgcatcctctgcctcctgggctccggcaatcctcccacctcagcctcccaagtagctgggactacaggcatgtgccaccatgcctggctaaatttttaattttttgtagagatgaggttttgccatgttgcccaggctggtctcaacctcctgggctcaagcaactctcccacctcggcctcctaaagtgctgggattacaggcatgagccaccacacccagccagttgaggtttgtatatatgtgccaaacatgttagactcatagatacgctatcctatgaaggtgggtatcattatctctgttttacaaaggaggagatcaaggtccagagaggttgggtatgagatgaggacatgtagctggcaggtggggagctgggcttctattcaggtcactctgaccctgtccagagtggccgtagggcctctcagcaggacgtatacagctgatgtgctgttttaatatgggaaacttttctcttataccatcaatgattagtctcaaaaaattcacttcacacccactgttgacttgcttcatgactgggtgtatataattagactaaatatccaggcactagatttaattttggggttttcattcataagtttgatattgacatggttggcagttctaatagtctttcaaataaaatgtgtgaaatttattatgtgtattttatatagagttttgtttgtaagtctgttttttttctccaccccctccttctctcaaaatagaaactagttcaaattcttgttacagtgtcctgaatataaatttctttgtcaccaggttaattttgattctgaaaatggaccaacagtttacaacaccctgaagaaaatatttaagcacacgctggaagaaaaaagaaaaatgacaaaagatggccctaagcctggcctctagctttcactcgtggtgaatatttcagacctaaagatccagatagtatctctgttcatatgtgaataagttgaagattgtggggctactttttctcatagcactttattttgaatgttgttagtttgtgctgagaatggtcgtccgtatttgaaccaattatttattttaaaatatatttaagctacatttttgttttgaaaaattgccataaatttggtgccactttcttttatttatttgactgagttaatattattgtattaacattttaagtatatggtgtttacattcttatttcttttgacattttggaaataatcataacttgtctttccaaaataaccattttcttgatggaactcttcctagagtttttaccaaatagctaactttagtagtaaaacctcattgtgtatccattcccccacagatgaactaagaaagtcaccaagtgtcttaagctgttttatatttgttacgaagaaggctattgctacaatatttttaaaggtttcttttttaactttgaaattttttgtttttccttttctttttataaatgtaacagagggtttcaaagcatattatttttcagagagatttagttttactttaatggagtgactgtgaagtggttgggattttttgcttgtagaaagtagacttgctctttgtcagatttccaaacaaccttgccagccttggctgtcaaaaggaggcaggagcagttctcaacacaccaagccttattcccactcccttgggttgctgctgagccaaatagcatctttacagaggaagtgggatcagaggcaggaagtgtggaaagttgctaagaagcagggcttgcctctgtcctcccggggactccacagggatattcgtgcagggcaggggctctgtgccagccctgctctctcagatgccacagccactctgcagaggtgactcttggagctggaggaagtcaaaactgggccactgtttgtactgatggtgtattagcatgagcagcgtggccctggccccacactcccaaatctgccactccatagacccacttgcctcaaggctttatatttggctgctttcttacaatgagaattaagatttttaaactgaagttgaccatacaggttgcattagccctaactggcttcatgtaagaagggtgactgcctaaactagttccttgtaagctgaaccatcaattatcagttgaagccatacttttatttaaattaatatacgtagataccagaggccaagccacagagaggataatagttcttcccaataaaggtgatattaatcagactaatttcgaactaaagaagttactgcttaaagacggaatttcaggggaagcaagactcatttagaacaaatgaaatttctccagtcctacatttctgaattgacttctagcacatcaaaaatatttcagtcattatcagtctcattaactgaaatgccaaatgctaaatgcagtgttctttcacactgttttaattttcttgggaaattgagtccagtggatgttaatggagtgggttgcccatccctgaaatgtcttattttcaagtgcctggcctgggaaagaaggggaagaaacaattgcattatatccaaagatacactataaaaatagagtttttaccaaaaaaagatgtttgttctcatctcagtaggcctcatttgggcaagtgacccacaggtcttttggcgagtttgctatttgcctgttgaaatacttgtttcaacttagagaacagttatgatgtgaccatagcatggcacaactaaaaatctaagcctgaaacctgaaaaaagagatatgacaagggaaattaatcaggctatacataagtattgtatttatttgaataaaaataaaaagagcaacccataatcctagtcctgtacttctttaccttgatgctctaggacatctgatgataaagacaaggttttgtcttagattatcctaataggcagattgagttgtcggctgattcagtgagccaagctctagttagtgcagactccttccatcagttcagcatgaccaaacactggggggttgggataggtgagttctaagaggaatagctggggaaaatctccaagctgacaagattcctaacttcccatatttggatgaggagttctttgtagcccagaggacagaaatctcacatattgggagaagtgataaggttgaaaaattcagttcaacagaaataggaaggttaagggcacacacatattaagaacttaccatgggccagccgtatccattacctcactgaattatcttgacagaagtcttttttatttcatttatttatatatatttttttgagacgggggtctcgctccgtagcccaagctggaatgcagtggcatgatcttggctgactgcaacctccgctcccagcctgaagccatcctcccacctcagcttcctgagtagctgggactacaggcacatgcaatcacatctggctaattttttgtttttttgtttttttggtattttttgtagagatagggtttcaccatgttacccaggcttgtcttgaactcctgagctcaagtgatcctcccacctcggcctcccagagtgctgggattacaggtgtgagccaccgcacctggcctcagaagtcttaatcataactgtgtgacgtgagatgtggagtccaatggaccccgtgctgtgccctcctctctgctcatgttacctgcctataggactcttaacctggcaaagctgcccgtcaaagtgccttctcagggaccttgaggtccctttagcactaaattttatgatggcattaagagaacactgtgctgtccataacttagtgaaaatatcacacatctgtcctggaaaaggctgaaccagctctattattatcctatgatgttctctagtatatcacacttagaggaagtacatgatttcttgccactgttgccttttcttacttcagagagcttactaatgccctttgagacaaattgctgctggtggtagagctcgcttcatttatttatgtaactcagaaaatctgtgctgagttacttagtcatatcttcatccagcttgccagtcttatctgagaaaaagtacttgcttcatcgttctggattccatgaaaaccaccatatatcataattcaacagaggtaaagtgtctctattttctcttaaatggagaatgcttgctgatatgattgggtgctatttcaggctagtctccacatgtccgaaaaaatatccagggacagtgtaatgtagatagaatgcaagccccaagttcttgacatctgacagccccatgtaatttggggggtcaatttaaaaatgacagcttactcataggatctttattattattccaaattagcaagcattaatatattttcagtgcaggtaaatcaagaacaatgttctctttgatgctttttatgaatggcacaagattagcatgttacctaagagagcttttctcaatgctagatggctgcaaattgtttatagataaagtagcaggagaaaaattcaacaaaatcctgtttctcagtgggtcattatttttttagttatgcttttaggcatgagctaatctctgattacctcaacactgacaataaaactgatttataaataatcacaatggaaccattcagtattggagcttgacaagcctttgttcaaagcccttcagtcactaaaaataatgtcccaataagacttaaatgtcataaaaccttttgcaacgaaaataaaagtttcatacatccactgaaacttgtacagtaagagaagcctgctaagcccttacctctcggctttcttgattaaaatgaaaagatattttactcttgagattgcctattttagagaaaaattacattttgaggatgggctcctgcttacccgatctctagaaagtggtctgacagtagcctctggttttgatttaatgagttgctttatcatttttttttctccttttaaaaatgaaaacagactgggcacggtggctataatctcagcactttgggaggccaagccaggcagatcacaaggtcaggagtttaagaccagctgggccaatatggtgaaaccctgtctgtactaaaaatacaaaaatcagccaggcgtggtgggcacctgtattcccagctacttggaaggctgagacaggagaatcgcttgaacctgggaggcggaggttgcagtgagccgagagcacaccactgcactccagcctgggcaacaaagcgagactccatctccagaaaaaaaaaaaaagaaagaaagaaaagaaaagaaaacaaactactcaggctcttgatttaggctgaaccatagggagtggccattttttttttggtaaaaaaatgatcaagtactggccattttatgtggttcaacctaaaatcaaactcagtatttccaggacaagtaggtgacatttcctgaattaattttggtaagtttagattaggtgatcaattattttctaagactatcctgtatgcttacagtagagttccaatacaactgtaagtgacaaatatgaaacattcttttagcaacacgtctgtgcctattctgcttggccctctgctaattctggggacacacaggaattatttattcagtcattcatccctctaggagtcacgttgcctatccctcaaaattcatgtgttggaaacttaattcccaatgcaatagagtaggaaggtgcagccttttaggaggtgtttaggtcgtcagagctccaccctcatgaatgaactaatattattagtaaaagacctgatggagggaattctttttttgcccttccactttctgtcatgtgaggacacagcatgctcccctccagatgatgcagcatgtaaggcaccatcttggaagcagagagcagccctcaccagatggcagtgccttaatcttggcctatccagcctccagaactgtgagaatcaatgtctgttgtttaagttgcccagcctgtgctattctgttatagcagcacaaaatggactaagacagcgattggtaccaggggagtggggtgttgctaaaacatacctaaaaatgtggaagcggctttggaactgggtaatgggttgaggctagaagagttgtgaaatgaaagcaggaaaaagcttgtattgccacgagtggagcattaagagtgattctggtgagggctcagaagaagaggagagctgtaaggaaattatcactcattcttctgagaaactacgtaagtggttttgaacagaatgctgataaaaacttggacagtaaagaccattccgattaggtcatagacagaaatgaggactatcattggaaactggggaaaaggccatctttgttacaaagtggcaaagaacgtggctgaattatgtccatgtccatgttctaggactttgtaaggggcagaacttagcgatgaaccagaatatttggcagaagaaatttctaagcaggaaagtgtgcaggatgctgtgtggtttctcttttttttttttttttttgaattgtgttgtcttttttttttttttttttattatactctaagttttagggtacatgttcacattgtgcaggttagttacatatgtatacatgtgccatgctggtgcgctgcacccactaacgtgtcatctagcattaggtatatctcccaatgctatccctcacccctcccccgaccccaccacagtccccagagtgtgatattccccttcctgtgtccatgtgatctcattgtttaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtggccgcaataaacatacgtgtgcatgtgtctttatagcagcatgatttatagtcctttgggtatatacccagtaatgggatggctgggtcaaatggtatttctagttctagatgcctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctccttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctggtctgttccattgatctatatctctgttttggtaccagtaccatgctgttttggttactgtagccttgtagtatagtttgaagtcaggtagtgtgatgcctccagctttgttcttttgtcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtcagagagggcatccctgtcttgtgccagttttcaaagggaatgcttccagttattgcccattcagtatgatattggctgtgggtttgtcatagatagctcttattattttgaaatacgtcccatcaatgcctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcccggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgttcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatctaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggagtcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcacactgtctggcactccctagtgagatgaacccggtacctcagatggaaatgcagaaatcacccgtcttctgcgtcgctcacgctgggagctgtagaccggagctgttcctattcggccatcttggctcctcccctgt

SEQ ID NO: 12831 - DNA, 11838 bp, Homo sapiens
aagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtagaatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaatt

SEQ ID NO: 12832 - DNA, 6102 bp, Homo sapiens
  misc_feature (6086)..(6086): n equals a,t,g, or c
cttttcttttttttttaattatactttaagttttaaggtacatgtgcacaacgtgcaggtttgttacatatgtatacatgtgccatgttggtgtgctgcacccattaactcgtcatttaacattaggcatatctcctaatgctattccctcccccgtccccctattccacaacaggccctggtgtgtgatgttccccttcctgtgtccatgtgttctcattgtttaattcccacctatgagtgagaacatgcggtgttttgttttttgtcctggcgatagtttgctgagactggtttccagcttcatccatgtccctacaaaggacatgaactcatcattttttacggctgcacagtattccatggtgtatatgtgccacattttctttttttttttttttaattatactttaagttttagggtacatgtgcacattgcgcaggttagttacatatgtatacatgtgccatgctggtgtgctgcacccactaactcgtcatctagcattaggtatatctcccaatgctacccctcccccctccccccaccccaccacagtccacagagtgtgatattccccttcctgtgaccatgtgatctcattgttcaattcccacctatgagtgagaatatgcggtgtttggttttttgttcttgcgatagtttactgaaaatgatggtttccaatttcatccatgtccctagaaaggacatgaactcatccttttttatggctgcatagtattccatggtgtatatgtgccacattttcttcatccagtctatcattgttggacatttgggtcggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgtactagtttacagtcccaccaacagtgtaaaagtgttcctatttctccacatcctctccagcacctgctgtttcctgactttttaatgattgccattctaactggtgtgagatggtatctcatagtgttttgatttgcatttctctgatggccagtgatgatgagcattttttcatgtattttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccaggttgtaggttgcctgttcactctgatggtagtctcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtaggcttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttctcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactatagattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattctcctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtgtttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgctataatttctgttcttttacatttgctgaggagagctttacttccaactatgtggtcaattttggaataggtgtggtgtggtgctgaaaaaaacgtatattctgttgatttggggtggagagttctgtagatgtctattaggtccacttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttcagcctatgtgtgtctctgcacatgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttactttggctggatatgaaattctgggttgaaaattcttttctttaagaatgttgaatattggcccccactctcttctggcttgtagggtttctaccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccctcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggtagtctgcccgttctcagatctccagctgcgtgctgggagaaccactgctctcttcaaagctgtcagacagggacatttaagtctgcagaggttcctgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggctcccctcccccagcctcgctgccgccttgcagtttgatctcagactgctgtgctagcaatcagcgagattccgtgggcgtagcaccctccaagccaggtgtgggatantagtctcgtggtgcgc

SEQ ID NO: 12833 - DNA, 8041 bp, Homo sapiens
ttttttatttttattttttattttattttattattattatactttaagttttagggtacatgtgcacaatgtgcaggttagtttcatatgtatacatgtgccatgctggtgtgctgcacccattaactcgtcatttagcattaggtatatctcctaaagctatccctccccctggccccaccctgcaacagtccccagagtgtgatgttccccttcctgtgtccatgtgttctcattgttcagttcccacctatgagtgagaatatgcggtgtttggtttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccacaataaacatacctgtgcatgtgtctttatagcagcatgatttatagtcctttgggtatatacccagtaatgggatggctgggtcaaatggtatttctatttctagatccctgaggaatcaccacactgacttccacaagggttgaactagtttacagtcccaccaacactgtaaaagtgttcctgtttctccacatcctctccagcacctgttgtttcctgactttttaatgattgccattctaactggtgtgagatggtatctcattgtggttttgatttgcatttctctgatggccagtgatggtgagcattttttcgtgtcttttttggctgcataaatgtcttcttttgagaagtgtctgttcatatccttcgcccactttttgatgcggttgtttgtttttttcttgtaaatttgtttgagttcattgtagattctggatattagccctttgtcagatgagtaggttgcgaaaattttctcccattttgtaggttgcctgttcactctgatggtagtttcttttactgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtcgaacgtttaagtctttaatccatcttgaattaatttttctataaggtgtaaggaagggatccagtttcagctttctacctatggcaagccagttttcccagcaccatttattaactagggaatcctttccccattgcttgtttctctcaggtttgtcaaagatcagatagttgtagatatgcggtgttatttctgagggctctgttctgttccattgatctatatatctgttttggtaccagtaccatgctgttttggttactgtagccttgtagtatagtttgaaatcaggtagcatgatgcctccagctttgttcttttggcttaggattgacttggtggtgtgggctcttttttggttccatatgaactttaaagtagttttttccaattctgtgtagaaagtcattggtagcttgatggggatggcattgaatctataaattaccttgggcagtatggccattttcacaatattgattcttcctacccatgagcatggaatgttcttccatttctttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacattggggctttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatacatagctcttattattctgagatacgttccatcaatacctaatttattgagagtttttagcatgaagcattgttgaattttgtcaaaggccttttctgcgtctattgagataatcatgtggtttttgtcttttgttctgtttatatgctggattacatttattgatttgtgtatattgaaccagccttgcatcacagggatgaagcccacttgatcatggtggataagccttttgatgtgctgctggatttggtttgccagtattttactgagtatttttgcatcagtgttcatcaaggatattggtctaaaattctcttttttggttttgtctctgcctagctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagttattgattattgccacaatttcagatcctgtgattcagatcctgtgattcagatcctgtgtattcagagagtcaacttcttcctggtttagtcttgggagggtgtatgtgtccaggaatttatccatttcttctagattttctagtttatttgtgtagaggtgtttgtagtattctctgatggtagtttgtatttctgtgggattggtggtgatatcccctttatcattttttattgcatctatttgattcttctctcttttcttctttattagtcttgctagtggtctatcaattttgttgatcctttcataaaaccagctcgtggattcattaattttttgaagggttttttgtgtctctatttccttcagttctgctctgatcttagttatttcttgccttctgctagcttttgaatgtgtttgctcttgcttttctgtgtcttttaattgtgatgttagggtgtcaattttaaatctttcctgctttctcttgtgggcatttagtgctataaatttccctctacacactgctttgaatgtgtcccagagattctggtgtgttgtgtctttgttttcgttggtttcaaagaacatctttatttctgccttcatttcattatgtacccagtagtcattcaggagcaggttgttcattttccacgtagttgagtggttttgagtgagtttcttaatcctgagttctagtttgattgcactgtggtctgagagacagtttgttataatttctgatcttttacatttgctgaagagagctttacttccaactatgtggtcaattttggaataggtgtggtgtggtgctgaaaaaaatgtatattctgttgatttgggttggagagttctgtagatatctattaggtccgcttggtgcagagctgggttcaattcctgggtatccttgttaactttctgtctcgttgatctgtctaatgttgacagtggggtgttaaagtctcccattattattgtgtggcagtctaagtctctttctaggtcactcaggacttgctttatgaatctgggtgctcctgtattgggtgcatatatacttaggatagttagctcttcttgttgaattgatccctttaccattatgtaatggccttctttgtctcttttgatgtttgttggtttaaagtctgttttatcagagactgggattgcaacccctgcctttttttgttttccatttgcttggtagattttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggctattttgctcgttagttgatgccgtttcttcctagcctcgatggtctttacaatttggcatgattttgcagtggctgccaccggttgttcctttccatgtttagtgcttccttcgggagctcttttagggcaggcctggtggtgacaaaatctctcagcatttgcttgtctgtaaagtattttatttctccttcacttatgaagcttagtttggctggatatgaaattctggtttgaaaattcctttctttaagaatgttgaatattggcccccactctcttctggcttgtagagtttctgccgagagatccgctgttagtctgatgggcttccctttgtgggtaacccgaccttcatctctggcctcccttaacattttttccttcatttcaacttttgtgaatctgacaattatgtgtcttgagttgctctttttgaggagtatctttgtggcgttcttgtatttcctgcatctgaacgttggcctgccttgctagattggggaagttctcctggataatatcctgcagagtgttttccaacttggttccattctccccatcactttcaggtacaccaatcagacgtagatttggtcttttcacatagtctcatatttcttggaggctttgttcgtttctttttattctgttttctctaaacttcccttctcgcttcatttcattcacttcatcttccatcactgataccctttcttccagttgatcgcatcagctcctgaggcttctgcattcttcacgtagttctcgagccttggctttcagctccatcagctcctttacgtacttctctgtattagttattctagttatacattcgtcaaaatcattttcaaagttttcaacttctttgcctttggtttgaatttcctcctgtagctcagagtagtttgatcgtctgaagccttcttctctcaactcgtcaaagtcattctctgtccagctgtgttccgttgctggtgaggagctgcgttcctttggaggaggagaggtgctctgctttttagagtttccagtttttctgctgtgttttttccccatctttgcggttttatctacttttggtctttgatgatggtgatgtacagatgggtttttggggtggatgtcctttctgtttgttagttttccttctaacagacaggaccctcagctgcaggtctgttggagtttgctagaggtccactccagaccttgtttgcctgggtaccagcagcggtggctgcagaacagtggatttttgtgaaccgcaaatgctgctgtctgatcgttcctctggaatttttgtctcagaggagtacccggccgtgtgaggtgtcagtctgcccctactggggggtgcctcccagttaggctgctcgggggtcaggggtcagggacccacttgaggaggcagtctgccctttctcagatctccagctgcgtgctgggagaatcactgctctcttcaaagctcagatggaaatgcagcctctaatatctctatttggctcacaaccctcaagtagttctcttcagggtttcagcaaatcttgccctataaatgcctaatattaagccagtggcttaaggtgaccttagaaaagatttctgaagcttcatctctaaacagctacctcctctctactaacctgcttcataaatcccagccacaatgctaataatgtctaccttagacaccatcaatttctctttgggttctatttcactgcgttcctaatcaaaaagccagggtaaatgtgttgcttacctccagtagttctttcttttccaggatagcagtgttgtggagtctgttgttagatgtctaaaaagagttgctgcttatgtattttttgagtgttatatttgtttatggctgaagggtaaatctaatagttataaccctgtcattattcagatgaagaatttgtcattttaagtttctcttttttatattcaccacctaccattctacagtattttttgattctttgtgggatttttctctgtctctacaataacttaacttccatgagaagtgattctgtcagtcttactcaattcagatctctagtgctcagaagagtgcttggtactcatgaataaacaacaaatatttaataaaattaaatgaaatgaatgagtaaattattgaataattatgcacagatgaaatttgcttcagaacatattaaaaattttacactagcaatataaaagaataggtgaatagatgttgaaaaaatttgtgcaaaacctatgatattgaagaagaaaataaggggcagacaaagaagtgaaggaataaaaaatgaagaagaaataagaagacagtaaaagaggaaaatggaaaagaagaaagtttgtagaattgtggagaaaaaaagacaaaaagacaagagaagaaatgaggatatttttgtaaaaaggaaaggaagaaaaagaaaagaggcaagtattattttaattctctaacacagcaaacatactgtgccctgactttgtattttaaggcaaaattctagggctgcaatggtgaaaatagttgggttattctttctaaacacctttatccccaaacatatttgccctgatgtgtaagaaatacacacaaaaatataatccaacttagattatgagtgccataggaaagtgctgtgagaagagtgatatcaaaaccttatatggggatctagctaggtaggcatcttagagaaagtgactaagtttgaaggatgaatagaaattaaacagatgttatgggaggaaacaatttgacaaaaggtttggaataaggaaaagaaagagcatggaacagaaattgtaaaagtttctgattggctttcctaataatgtctgaatgacgctgttgggaatgtgtattgggaatgcaagtttaagtctcacatggagagtctcgaatattgtgctaggagtttgaacttttaagtgctctttagcttttggaaacctctgagagtttttcaataagaaagtaataagctcagatcagtgattttagaacataaaatgtaattttaaaaagcagagaaataaatagaaaagagagagaaggcaactttgagcaaaacttttttcttaaaaaaagcgtttttggcacttagttctagaaatgatagaaaaacagatggaaaagatgttggtactggaaattattttatcagtctgtttttatcctgcttgctaagaaagggcatgacttttttattatgcatctaaggatctcttttactttgagccattttcacttggacacattatagttgagtgctgatattactgatgtgcttcctcccctaaatccccttgcccaacaggggttaagtcttgtaggcctaagtgtctgaaaactctgctcctctaacgtgaaaaatcaaacaaaaacaaatgaaacaccaccagttatcaggaatcagcgtttctctgcaacaaaagaaaatagaggatcatgttcacccactctgctttatttatgggaattaaattgggtttggtgtacagaatatctctatctcaataaaattcaagtgctgcgcagaagataaacggaatatacttttaaatgaaattgcttttcgttttggcagcagggtatttggtcattcaggaacttttgcacctctcacttttcacagaaggtcttttagagatgtatttcagctaaggagctcacctctatgaaaggaggactgggcccctagggttagctcttaaagattacttctaagtcatttcaagcattctgaatatttttcagttatgttcattcagactgatttgatatccatgggcaatattattttgaggtaacacttcataagtattaaaaaaaattactgtcccccccatttgaactatttaaaaagagagttaatggaatgtagagttacttaatttatgataaaattcatacc

SEQ ID NO: 12834 - DNA, 4995 bp, Homo sapiens
tttttcttttttttgatttgagtgtattttattttattttattttttattatactaagttctagggtacatgtgcacaacgtgcaggtttgttacatatgtatacatgtgccatgttggtgtgctgcacccattaactcgtcatttacattaggtatatctcctaatgctatccctcccctctccccgcaccctatgacaggccctggtgtgtgatgttccccatcctgtgtccaagtgttcttattgttcaattcccacctatgagtgagaacatgtggtgtttgggtttctgtccttgcgacagtttgctcagaatgatggtttccagcttcatccatgtccctacaaaggacatgacctcatccttttttatggctgcatagtattccatggtgtatatgtgccacattgtcttaatccagtctatcattgatggacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcaccattctaactgctgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgatttttttcttgtaaattagtttaagttctttgtagattctggatattagccctttgtcagatgggtagattgcaaaaattttctcccattttgtaggttgtctgttcactctgatggtagtttcttttgctgtgcagaagctctttagtttaattagatcccatttgtcaattttgtcttttgttgccattgcttttggtgttttagacatgaagtccttgtccatgcctatgtcctgaatggtattgccaaggttttcttctagggtttttatggttttaggtctaacatttaagtctttaatccatcttgaattaattttttataaggtgtaaggaagggatccagttccagccttctgcatatgggctagccagttttcccagcaccatttattaaatagggaatcctttccccatttcttgtttttgtcaggtttgtcaaagatcagatggttgtagatgtgtggtattatttctgagggctctgttttgttccattggtctatatctttgttttggtaccagtaccatgctgttttggttactgtaggcttgtagtataggttgaagtcaggtagcgtgatgcctccagctttgttcttttggcttaggattgacttggcaatgcgggctcttttttggttccatatgaactttaaagtagttttttccaattctgtaaagaaagtcattggtagcttgatggggatggcattgaatctataaattaccttgggcagtatggccattttcacaatattggttcttcctatccataagcatgcaatgctcttccatttgtttgtgtcctcttttatttggttcagcagtggtttgtaattctctttgaagaggttattcacatcccttgtaagttggattcctaggtattttattctctttgtagcaattgtgaatgggagttcactaatgatttggctctctgtttgtctgttattggtgtataggaaagcttgtgatttttgcatattgattttgtatcctgagaccttgctgaagttgcttatcagcttaaggagattttgggctgagatgtgggttttctaaatatacagtcatgtcatctgcaaatagggacaatttgacttcctcttttcctaattgaataccctttgtttatttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtgatttttgtctttggttctatttatatgctggattacatttattgatttgcatatgttgaaccatccttgcatcccagggatgaagcccacttgatcatggtggataagctttttgatgtgctgctggatttggtttgccagtattttattgaggatttttgcatcgatattcatcagggatattggtctaaaattctcttttttggttgtgtctctgccaggcttcggtatcaggatgatgctggcctcataaaatgagttagggaggattccctctttttctattgattggaatagtttcggaaggaacggtgccagctcctctttgtacctctggtggaattcggctgtgaatccatctggtcctggactttttttggttggtaggctcttaattattgcctcgatttcagagcctgttattggtctattcagggattcaacttcttcctagcttagtcttgggagggtgtatgtgtccaggaatttatccatttcttctagattttctagtttatttgcatagaagtgtttatagtattctctgaggtagtttgtatttctgtgggatcggtggtgatatcccctttatcattttttattgtgtctatttgattcttctctgttttcttctttattagtcttgctagcggtctatcaattttgttgatcttttcaaaaaaccacatcctggattcattgattttttgaagggctttttgtgtctctatctccttcagttctgctctgatcttagttatttcttgccttctgctagcttttgaatgtgtttgctcttgcttctctagttcttttaattgtgatgttagggtatcaattttagatctttcctgctttctcttgtgggcatttagtgctataaatttccctctacacactgctttaaatgtttcccagagattctggtatgttgtgtctttgttttcatcggtttcaaagaacatctttatttctgtcttcatttcattatgtacccagtagtcattcaagagcaggttgttcagtttccatgtagttgagcggttttgagtgagtttcttaatcctgagttctagtttgattgcactgtggtctgagagacagttcgttataatttctgttcttttacatttgctggggagtgctttacttccaactatgtggtcaattttggaataagtgcgatgtggtgctgagaaggatgtatattctgttgatttatggtgtagagttctgtagatgtctattaggtccacttggtgcagagctgagttcaattcctggatatccttcttaactttctgtctcgtggatctgtctaatgttgacagtggggtgttaaagtctcccattattattgtgtgggagtctaagtctctttataagtctctaaggacttgctttatgaatctcagtgctcctgtattgagtgcatatatatttaggatagttagctcttcttgttgaattgatccctttaccattatgtaatggccttctttgtctcttccgatctttgttggtttaaagtctgttttatcagagactaggattgcaacccctgctttttttttttgttttccatttgcttggtagatcttcctccatccctttattttgagcctatatgtgtctctgcacgtgagatgggtctcctgaatacagcacactgatggatcttgactctttatccagtttgccagtctgcgtcttttaatcggcacatttagcccatttacatttaaggttaatattgttatgtgtgaatttgatcctgtcattatgatgttagctggttattttgcttgttagttgatgcagtttcttcctagcctgatggtctttacaatttggcatgtttttgcagtggctggtaccagttgttcttttccatgtttggtgcttccttcaggagctcttgtaaggcaggcctggtggtgacaaaatctctcagcatttgcttgtctgtaaaggattttatttctccttcaattatgaagcttagtttggctggatatgaaattctgggttgaaaattctgtcctttaagaatgttgaatattggcccccattctcttctggcttgtagagtttctgctgagagatcagctgttagtctgatgggcttccctttgtgggtaacctgacctttctctctggctgccctgaacattttttccttcattttgactttggtgactctgacaattatgtgtcttggagttgctcttctcgaggagtatctttttggcgttctctgtgtttcctgaatttgaatgttggcttgccttgctaggttggggaagttctcctggataatatcctgaagagtgttttccaacttggttccattctccccatcactttcaggtacaccaatcagacatagatttggtcttttcacatagtcccatatttcttggaggctttgttcgtttctttttaatcttttttctctaaacttctcttctcacttcatttcattcatttaatcttcaatcactgatacctattcttccagttgatcgaattggctactgaagcttgtgcatgcattacatagttctcgtgccatggttttcagctccatcaggtcatttaagttcttctctacgctgtttattccagttagccattcgtctactcttttttcaaggtttttagcttctctgcgatgggttccaacatcctcctttag

SEQ ID NO: 12835 - DNA, 5453 bp, Homo sapiens
tctgccctctagtgtcttttgttcccatctttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcaatggtctttacattttggcatgattttgcagtggctggtaccggttgttcctttccatgtttagcgcttccttcaggagctcttttagggcaggcctggtggtgacaaaatctctcaacatttgcttgtctataaagtattttatttctccttcacttatgaagcttagtttggctgtatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagct

SEQ ID NO: 12836 - DNA, 4137 bp, Homo sapiens
tttttgttggttttttttttttcactttcttttttttttttaatttatttttttattattatactttaagttttagcgtacatgtgcacattgtgcaggttagttacatacgtatacatgtgccatgctggtgtgctgcacccactaactcgtcatctagcattaggtatatatcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttataccagcatgatttataatcctttgggtatatacccagtaatgggatggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatatcttctgttgagaagtgtctgttcatgtccttcacccactctttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctagattttcttctagggtttttatggttttaggtctaacgtttgagtctttaatccatcttgaattgatttttgtataagttgtaaggtagggatccagtttcagctttctacatatggctagccagttttcccagcaccatttatgaaatagggaatcctttccccatttcttgtttttgtcaggtttctcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggtttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttctctgttgttggtgtataggaatgcttgtgatttttgcacattgattttgtatcctgagactttgctgaagttgcttatcagcttaaggagattttgggctgagaaaatggggttttctagatatacaatcatgtcatctgcaaacagggacaatttgacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaacggttgttgaattttgtcaaaggcctttcctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttctttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggttctggactctttttggttggtaagctattgattattgccacaatttcagatcctgttattggtctattcagagattcaacttcttcctggtttagtcttaggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctgtttgattcttctctctttttttctttattagtcttgctagcggtctatcaattttgttgatcctttcagaaaaccagctcctggattcattaattttttgaagtgttttttgtgtctctatttccttcagttctgctctgattttagttatttcttgccttctgctagcttttgaatgtgtttgctcttgcttttctaattcttttaattgtgatgttagggtgtcaattttggatctttcctgctttctcttgtgggcatttagtggtataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgatcgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatagtgttatgtgtgaatttgatcctgtcattattatgttagctggttattttgctcgttagttgatgcagtttcttc

SEQ ID NO: 12837 - DNA, 6542 bp, Homo sapiens
tttttttattttttattttttcttgagttttttttttaatttatttatttattattattatactttaaggtttagggtacatgtgcacaatgtgcaggttagttacatatgtatacatgtgccatgctggtgggctgcacccactaactcgtcatctagcattagttatatctcccaatgctatccctcccccctcccccaaacccaccacagtccccagagtgtgatgttccccttcctgtgtccatgtgttctcattgtttaattcccacctatgagtgagaatatgcggtgtttggttttttgttcttgcgatagtttactgagaatgatgatttccaatttcatccatgtcactacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttaggttatatacccagtaatgggatggctgggtcaaatggtatttctagttctagatccctgaggaatcgccacactgacttccacaatggttgaactagtttacagtcccgccaacagtgtaaaagtgttcctatttctccacatcctctccagcacctgttgtttcctgactttttaatgattgccattctaactggtgtgagatagtatctcattgtggttttgatgtgcatttctctgatggccagtgatggtgagcattttttcatgtgttttttggctgcataaatgtcttcttttgagaaatgtctgttcatgtccttcgcccactttttgatggggttgtttggttttttcttgtaaatttgtttgagttcattgtagattctggatattagccctttgtcagatgagtaggttgcgaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgcccatgcctatgtcctgaatggtaatgcctaggttttcttctagggtttttatggttttaggtcgaacgtttaagtctttaatccatcttgaattgatttttgtataaggtgtaaggaagggatccggtttcagctttctacatatggctagccagttttcccagaaccatttattaaatacagaatcctttccccactgcttgtttttctcaggtttgtcaaagatcagatagttgtagatatgcggcgttatttctgagggctctgttctgttccattggtctctatctctgttttggtaccagtaccatgctgttttggtgactgtagccttgtagcatagtttgaagtcaggtagcgtgatgcctccagctttgttcttttggcttaggattgacttggcgatgcgggctcttttttggttccatatgaactttaaagtagttttttccaattgcgtgaagaaagtcattggtagcttgatggggatggcattgaatctgtaaattaccttgggtagtatggccattttcacgatattgattcttcctacccatgagcatggaatgttcttccatttgtttgtatcctcttttatttccttgagaagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggatgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgacgggttgttgaattttgtcaaaggccttttctgcatctattgagataatcatgtggtttttgtctttggttctgtttatatgctggattacatgtattgatttgcatatattgaaccagccttgcgtcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggactccctctttttctattgattggaatagtttcagaaggaatggtaccagttcctccttgtacctctggtagaattcggctgtgaatctatctggtcctggactctttttggttggtaagctattgattattgccacaatttcagatcctgttattggtctattcagagattcaacttcttcctggtttagtctttggagggtgtatgtgtcaaggaatttatccatttcttctagattttctagtttatttgcatagaggtgtttttagtattctctgatggtagtttgtatttctgtgggatcggtggtgatatcccctttatcattttttattgcgtctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacgtctttatttctgccttcatttcgttatgtacccagtagtcattcaggagcaggttgttcagtttccatgtagttgagtggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgacttgctgtctccttgatctgtctaatgttgacagtggggtgttaaagtctcccattattattgtgtgggagtctaagtctctttgtaggtcactcaggacttgctttatgaatctgggtgttcctgtattgggtgcatatatatttaggatagttagctcttcttgttgaattgatccctttaccattatgtaatggccttctttgtctcttttgatctttgttggttgaaagtctgttttatcagagactaggattgcaacccctgcctttttttgttttccatttgcttggtagattttcctccatccctttattttgagcctatgtgtgtctctgcacgtggatgggtttcctgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagcgcttccttcaggagctcttttagggcaagcctggtggtgacaaaatctctcagcatttgcttgtctgtaaagtattttatttctccttcacttttgaagcttagtttggctggatatgaaattctgggtcgaaaattcttttctttaagaatgttgaatattggcccccactctcttctggcttgtagagtttctgccaagagatctgctgttagtctgatgggcttccctttgagggtaacccgacctttctctctggctgcgcttaacatttttcccttcatttcaactttggtgaatctgacaattatgtgtcttagagttgctcttctcgaggagtatctttgtggcattctctgtatttcctgaatctgaatgttggcctgccttgctagattggggaagttctcctggatgatatcctgcagagtgttttccaacttggttccattctccccgtcagtttcaggtacaccaatcagacgtagatttggtcttttcacatagtcccgtatttcttggaggctttgtttgtttctttttattcttttttctctaaacttcccttcttgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagtaatacattcttcaaaatttttttcaaagttttcaacttctttgcctttggtttgaatgtcctcccgtagcttggagtaatttgatcgtctgaagccttattttctcagctcgtcaaagtcattctccgtccagctttgttctgttgttggtgaggagctgcgtttctttggaggaggagaggcactgcgttcctttggaggaggagaggcgctctgctttttagagtttccaggttttctgctctgttttttccccatctttgcagtttttatctacttttggtctttgatgatggtgatgtacagatgggtttttggtgtggatgtcctttctgtttgttagttttccttctaacagacaggaccttcagctgcaggtctgttgggttacccggccgtgtgaggtgtcagcctgcctctgctagggggtgcctcccagttacctcccagggggtgacctcccagggggtcaggggtcagggacccacttgaggaggcagtctgcccgttctcagatctccagctgtgtgctgggagaaccactgctctcttcaaactgtcagacagggacacttaagtctgcggaggttactgctgtctttttgtgtgtctgtgccctgcccccagaggtggagcctacagaggcaggcaggcttccttgagctgtggtgggctccacccagttggagcttcctggctgctttgtttacctaagcaagcctgggcaatggcgggcacccctcccccagcctcgctgccaccttgcagtttgatctcaggctgctttgctagcaatcagcgagactccgtgggcgtgggaccctccgagccaggtgtgggacacaatctcctggtgcgccgtttttcaagcccgtcggaaaagcgcagcattctggtgggagtgacccaatcttccaggtgccgtctgtcacccctttctttgactaggaaagggaactccctgacccccgtgcttcccaagtgagacaatgcctcgccctgcttcggctcgcggatggagcacgcacccactgacctgcgcccactgtctggcactccctagtgagatgaacccggtacctcagatggaaatggagaaatcgcctgtcttctgcgtctctaacgctgggagctgtataccggagctgttcctattcggccatcttggctcctctctcctctcttcactttaataatggattagttttctgccttctcctgtggggaatccttttggtaagggagggaagaaagattagttattcttgtgcatcggtatctttttctttttttattgtagtaagaacatctaacatgagatctaccctcttaacaattttttaagtgtacaatacagtattgctaactataggcatgaggatgtgcagcagatctctggaacgtttcactcttcataactgaagctttataccccttgaatcgcagtttcccatttccctgtcttcatagcccctggcatccaccattctacactctttctatggggttgactattttaattacctgacacaagtggaatcatgcattatttgtctttctgtgactggtttatttcatgtagcataaagtcatcaaggttcatc
